US009302014B2

(12) United States Patent
Gait et al.

(10) Patent No.: US 9,302,014 B2
(45) Date of Patent: Apr. 5, 2016

(54) CELL-PENETRATING PEPTIDES HAVING A CENTRAL HYDROPHOBIC DOMAIN

(75) Inventors: Michael John Gait, Cambridge (GB); Andrey Alexandrovich Arzumanov, Cambridge (GB); Amer F. Saleh, Cambridge (GB); Matthew J. A. Wood, Oxford (GB); Corinne Betts, Oxford (GB); Taeyoung Koo, Oxford (GB)

(73) Assignee: Medical Research Council, Swindon (GB)

( * ) Notice: Subject to any disclaimer, the term of this patent is extended or adjusted under 35 U.S.C. 154(b) by 38 days.

(21) Appl. No.: 14/240,832

(22) PCT Filed: Aug. 29, 2012

(86) PCT No.: PCT/GB2012/052116
§ 371 (c)(1),
(2), (4) Date: Jun. 25, 2014

(87) PCT Pub. No.: WO2013/030569
PCT Pub. Date: Mar. 7, 2013

(65) Prior Publication Data
US 2014/0342992 A1 Nov. 20, 2014

Related U.S. Application Data

(60) Provisional application No. 61/528,804, filed on Aug. 30, 2011.

(30) Foreign Application Priority Data

Aug. 30, 2011 (GB) .................................. 1115014.1
Jul. 3, 2012 (GB) .................................. 1211740.4

(51) Int. Cl.
| | | |
|---|---|---|
| C07K 14/08 | (2006.01) | |
| A61K 38/10 | (2006.01) | |
| A61K 47/48 | (2006.01) | |
| C07K 7/02 | (2006.01) | |
| C07K 14/00 | (2006.01) | |
| C12N 15/00 | (2006.01) | |
| A61K 38/16 | (2006.01) | |
| C07K 7/08 | (2006.01) | |

(52) U.S. Cl.
CPC ........... *A61K 47/48246* (2013.01); *A61K 38/10* (2013.01); *A61K 38/16* (2013.01); *C07K 7/02* (2013.01); *C07K 7/08* (2013.01); *C07K 14/00* (2013.01); *C07K 14/003* (2013.01); *C12N 15/00* (2013.01); *C07K 2319/10* (2013.01)

(58) Field of Classification Search
None
See application file for complete search history.

(56) References Cited

U.S. PATENT DOCUMENTS 7,153,931 B1 12/2006 Fischer et al.
8,575,305 B2* 11/2013 Gait et al. ..................... 530/325
2011/0105403 A1* 5/2011 Gait et al. ..................... 514/17.7
2011/0130346 A1 6/2011 Wood et al.
2012/0309684 A1 12/2012 Wood et al.

FOREIGN PATENT DOCUMENTS

| WO | WO 03/106491 | 12/2003 |
|---|---|---|
| WO | WO 2009/005793 | 1/2009 |
| WO | WO 2009/144481 | 12/2009 |
| WO | WO 2009/147368 | 12/2009 |
| WO | WO 2011/064552 | 6/2011 |

OTHER PUBLICATIONS

Aartsma-Rus et al. (2007) RNA, 13(10):1609-1624, "Antisense-mediated exon skipping: a versatile tool with therapeutic and research applications".
Abes et al. (2008) Nucleic Acids Research, 1-12, "Delivery of steric block morpholino oligomers by (R-X-R)$_4$ peptides: structure-activity studies".
Abes et al. (2006) Journal of Controlled Release 110:595-604, "Endosome trapping limits the efficiency of splicing correction by PNA-oligolysine conjugates".
Abes et al. (2006) Journal of Controlled Release 116:304-313, "Vectorization of morpholino oligomers by the (R-Ahx-R)$_4$ peptide allows efficient splicing correction in the absence of endosomolytic agents".
Abes et al. (2007) Biochemical Society Transactions 35(1):53-55, "Peptide-based delivery of nucleic acids: design, mechanism of uptake and applications to splice-correcting oligonucleotides".
Abes et al. (2007) Biochemical Society Transactions 35(4):775-779, "Cell-penetrating-peptide-based delivery of oligonucleotides: an overview".
Abes et al. (Jun. 2007) Nucleic Acids Research 35(13):4495-4502, "Efficient splicing correction by PNA conjugation to an R$_6$-Penetratin delivery peptide".
Alter et al. (Feb. 2006) Nature Medicine 12(2):175-177, "Systemic delivery of morpholino oligonucleotide restores dystrophin expression bodywide and improves dystrophic pathology".
Amantana et al. (2007) Bioconjugate Chem. 18:1325-1331, "Pharmacokinetics, Biodistribution, Stability and Toxicity of a Cell-Penetrating Peptide-Morpholino Oligomer Conjugate".
El-Andaloussi et al. (2006) The Journal of Gene Medicine 8:1262-1273 "Induction of splice correction by cell-penetrating peptide nucleic acids".
El-Andaloussi et al. (Oct. 2007) www.moleculartherapy.org 15(10):1820-1826, "A Novel Cell-penetrating Peptide, M918, for Efficient Delivery of Proteins and Peptide Nucleic Acids".
Arechavala-Gomeza et al. (Sep. 2007) Human Gene Therapy 18:798-810, "Comparative Analysis of Antisense Oligonucleotide Sequences for Targeted Skipping of Exon 51 During Dystrophin Pre-mRNA Splicing in Human Muscle".

(Continued)

*Primary Examiner* — John Ulm
(74) *Attorney, Agent, or Firm* — Swanson & Bratschun, L.L.C.

(57) ABSTRACT

The present invention discloses cell penetrating peptides (CPP or membrane translocating peptide) and their conjugates with cargo molecules. The peptides are useful as drug delivery systems, particularly as delivery vehicles for nucleotide-based therapeutics, such as polynucleotides, oligonucleotides and peptide nucleic acids. A CPPs of the invention provides a balance between good cell entry efficiency and low toxicity and comprises three contiguous domains: the central one being hydrophobic and the flanking ones consisting of arginine and aminohexanoic acid or beta-alanine residues. The hydrophobic domain contains a sequence selected from YQFLI, YRFLI, IQFLI and IRFLI.

34 Claims, 83 Drawing Sheets

(56) References Cited

OTHER PUBLICATIONS

Bendifallah et al. (2006) Bioconjugate Chem. 17:750-758, "Evaluation of Cell-Penetrating Peptides (CPPs) as Vehicles for Intracellular Delivery of Antisense Peptide Nucleic Acid (PNA)".

Boisguerin et al. (2011) Journal of Controlled Release 156:146-153, "Systemic delivery of BH4 anti-apoptotic peptide using CPPs prevents cardiac ischemia-reperfusion injuries in vivo".

Cossu et al. (2007) Trends in Molecular Medicine, 13(12)"520-526, "New therapies for Duchenne muscular dystrophy: challenges, prospects and clinical trials".

Du et al. (Apr. 3, 2007) Proc Natl Acad Sci U S A. 104(14):6007-6012, "Correction of prototypic ATM splicing mutations and aberrant ATM function with antisense morpholino oligonucleotides".

Eckstein (2007) Expert Opin. Biol. Ther. 7(7): 1021-1034, "The versatility of oligonucleotides as potential therapeutics".

Egholm et al. (1992) J. Am. Chem. Soc. 114:1895-1897, "Peptide Nucleic Acids (PNA). Oligonucletotide Analogues with an Achiral Peptide Backbone".

Esau et al. (Feb. 2006) Cell Metabolism 3(2):87-98, "miR-122 regulation of lipid metabolism revealed by in vivo antisense targeting".

Fabani et al. (2008) RNA 14:336-346, "miR-122 targeting with LNA/2'-O-methyl oligonucleotide mixmers, peptide nucleic acids (PNA), and PNA-peptide conjugates".

Fletcher et al. (2006) J. Gene Med. 8(2):207-216, "Dystrophin expression in the *mdx* mouse after localised and systemic administration of a morpholino antisense oligonucleotide".

Fletcher et al. (Sep. 2007) Molecular Therapy 15(9):1587-1592, "Morpholino Oligomer-Mediated Exon Skipping Averts the Onset of Dystrophic Pathology in the *mdx* Mouse".

International Search Report and Written Opinion mailed Apr. 23, 2013 in PCT/GB2012/052116.

Ivanova et al. (2008) Nucleic Acids Research 36(20):6418-6428, "Improved cell-penetrating peptide-PNA conjugates for splicing redirection in HeLa cells and exon skipping in *mdx* mouse muscle".

Ivanova et al. (2008) Nucleic Acids Symposium Series (Oxf). 52:31-32, "PNA-peptide conjugates as intracellular gene control agents".

Jearawiriyapaisarn et al. (Sep. 2008) www.moleculartherapy.org, 16(9):1624-1629, "Sustained Dystrophin Expression Induced by Peptide-Conjugated Morpholino Oligomers in the Muscles of *mdx* Mice".

Jopling et al. (Sep. 2, 2005) Science 309(5740):1577-1581, "Modulation of Hepatitis C Virus RNA Abundance by a Liver-Specific MicroRNA".

Kang et al. (1998) Biochemistry 37:6235-6239, "Up-Regulation of Luciferase Gene Expression with Antisense Oligonucleotides: Implications and Applications in Functional Assay Development".

Kichler et al. (Feb. 18, 2003) Proc Natl Acad Sci U S A., 100(4):1564-1568, "Histidine-rich amphipathic peptide antibiotics promote efficient delivery of DNA into mammalian cells".

Kole et al. (2004) Oligonucleotides 14:65-74, "Modification of Alternative Splicing by Antisense Therapeutics".

Krutzfeldt et al. (Dec. 1, 2005) Nature vol. 438:685-689, "Silencing of microRNAs in vivo with 'antagomirs'".

Kurreck (2003) Eur. J. Biochem. 270:1628-1644, "Antisense technologies".

Lebleu et al. (2008) Advanced Drug Delivery Reviews 60:517-529, "Cell penetrating peptide conjugates of steric block oligonucleotides".

Lu et al. (Jan. 4, 2005) Proc Natl Acad Sci U S A. 102(1):198-203, "Systemic delivery of antisense oligoribonucleotide restores dystrophin expression in body-wide skeletal muscles".

Madsen et al. (Mar. 11, 2008.) Proc Natl Acad Sci U S A. 105(10):3909-3914, "In vivo correction of a Menkes disease model using antisense oligonucleotides".

Moulton et al. (2004) Bioconjugate Chem. 15:290-299, "Cellular Uptake of Antisense Morpholino Oligomers Conjugated to Arginine-Rich Peptides".

ROMPP online: XP-002543257, ID=RD.14-01696 Norleucin Apr. 2009.

Rothbard et al. (2002) J. Med. Chem. 45:3612-3618, "Arginine-Rich Molecular Transporters for Drug Delivery: Role of Backbone Spacing in Cellular Uptake".

Saleh et al. (2010) Biconjugate Chem. 21(10):1902-1911, "Synthesis and Splice-Redirecting Activity of Branched, Arginine-Rich Peptide Dendrimer Conjugates of Peptide Nucelic Acid Oligonucleotides".

Saleh et al. Collection Symposium Series (2011) Institute of Organic Chemistry and Biochemistry, Academy of Sciences of the Czech Republic, Prague, in press. "Enhancement of exon skipping and dystrophin production by 3'-peptide conjugates of morpholino (PMO) oligonucleotides in a mdx mouse model of duchenne muscular dystrophy".

Scaffidi et al. (May 19, 2006) Science 312(5776):1059-1063, "Lamin A-Dependent Nuclear Defects in Human Aging".

Seabra et al. (2007) European Journal of Cancer 43:1483-1492, "Proteomic co-expression of cyclin-dependent kinases 1 and 4 in human cancer cells".

Soifer et al. (Dec. 2007) www.moleculartherapy.org vol. 15(12):2070-2079, "MicroRNAs in Disease and Potential Therapeutic Applications".

Summerton et al. (1997) Antisense & Nucleic Acid Drug Development 7: 187-195, "Morpholino Antisense Oligomers: Design, Preparation and Properties".

Turner et al. (2005) Nucleic Acids Research, 33(1):27-42, "Synthesis, cellular uptake and HIV-1 Tat-dependent *trans*-activation inhibition activity of oligonucleotide analogues disulphide-conjugated to cell-penetrating peptides".

Turner et al. (2005) Nucleic Acids Research, 33(21):6837-6849, "Cell-penetrating peptide conjugates of peptide nucleic acids (PNA) as inhibitors of HIV-1 Tat dependent *trans*-activation in cells".

Turner et al. (2006) Penetrating Peptides, 2nd Edition. (U. Lange) Ed.) CRC Press, Boca Raton pp. 313-328, "Peptide Conjugates of Oligonucleotide Analogs and siRNA for Gene Expression Modulation".

Turner et al. (2007) Blood Cells, Molecules and Diseases 38:1-7, "RNA targeting with peptide conjugates of oligonucleotides, siRNA and PNA".

van Deutekom et al. (Dec. 27, 2007) N Engl. J Med. 357(26):2677-2686, "Local Dystrophin Restoration with Antisense Oligonucleotide PRO051".

Wu et al. (2007) Nucleic Acids Research, 35(15):5182-5191, "Cell-penetrating peptides as transporters for morpholino oligomers: effects of amino acid composition on intracellular delivery and cytotoxicity".

Wu et al. (Sep. 30, 2008) Proc Natl Acad Sci U S A. 105(39):14814-14819, "Effective rescue of dystrophin improves cardiac function in dystrophin-deficient mice by a modified morpholino oligomer".

Yin et al. (2008) Human Molecular Genetics, 17(24):3909-3918, "Cell-penetrating peptide-conjugated antisense oligonucleotides restore systemic muscle and cardiac dystrophin expression and function".

Yin et al. (Jan. 2008) www.moleculartherapy.org 16(1) 38-45, "Effective Exon Skipping and Restoration of Dystrophin Expression by Peptide Nucleic Acid Antisense Oligonucleotides in *mdx* Mice".

Yin et al. (Jul. 2011) Molecular Therapy 19(7):1295-1303, "Pip5 Transduction Peptides Direct High Efficiency Oligonucleotide-mediated Dystrophin Exon Skipping in Heart and Phenotypic Correction in *mdx* Mice".

Zatsepin et al. (2005) Current Pharmaceutical Design, 11:3639-3654, "Conjugates of Oligonucleotides and Analogues with Cell Penetrating Peptides as Gene Silencing Agents".

\* cited by examiner

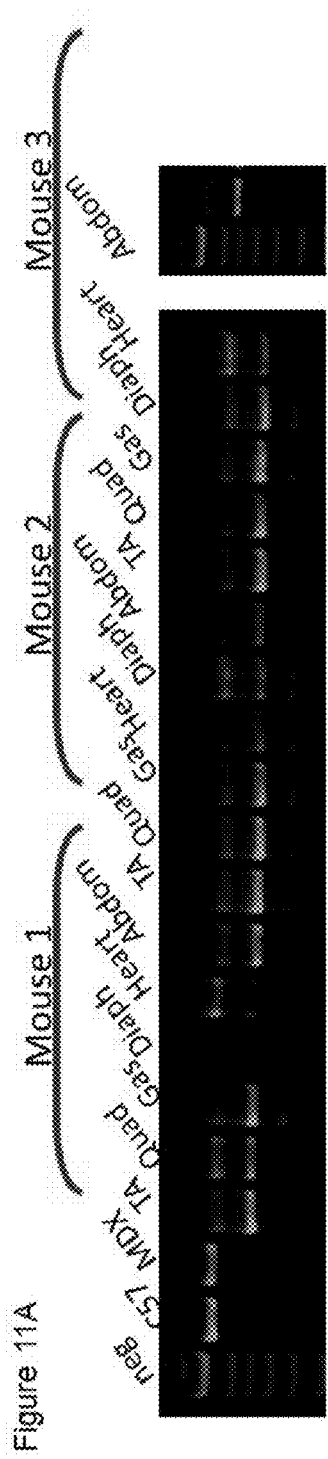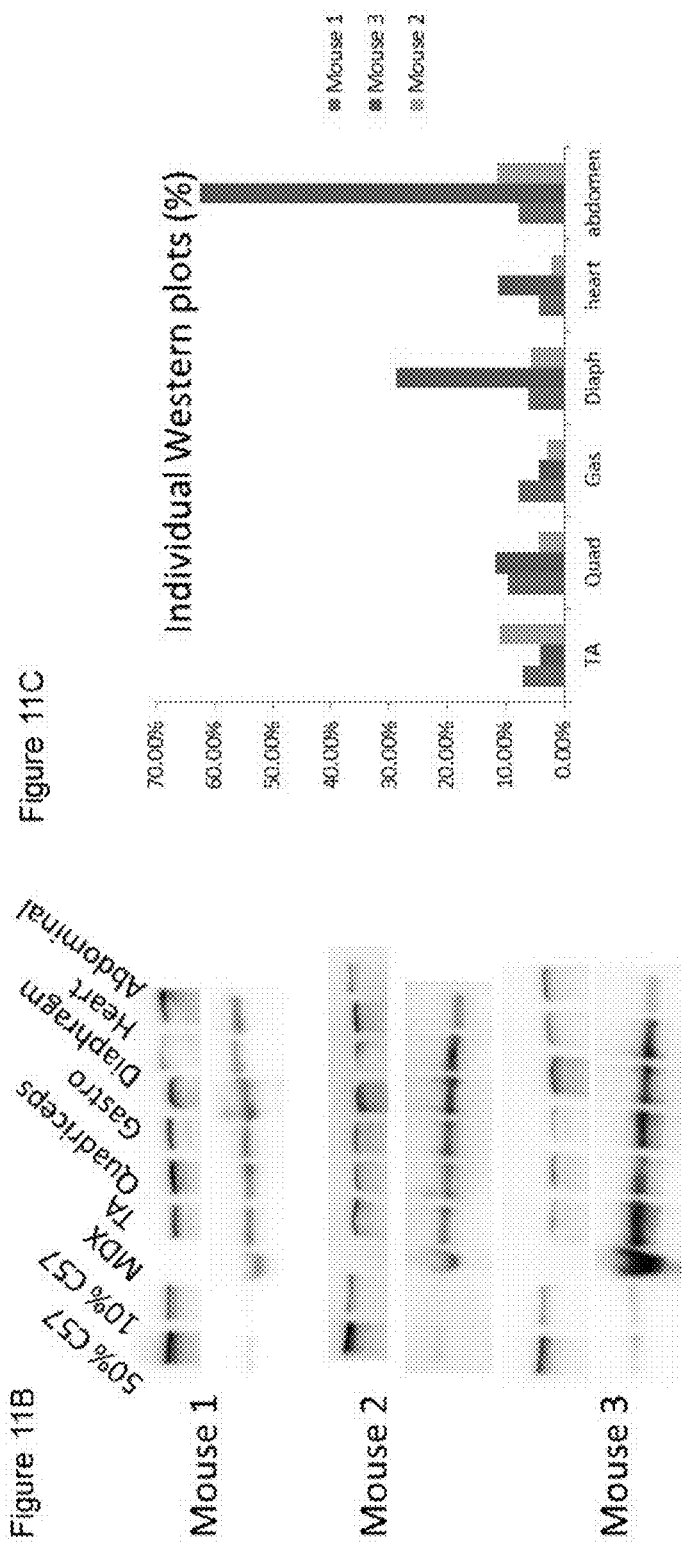
Figure 11A
Figure 11B
Figure 11C

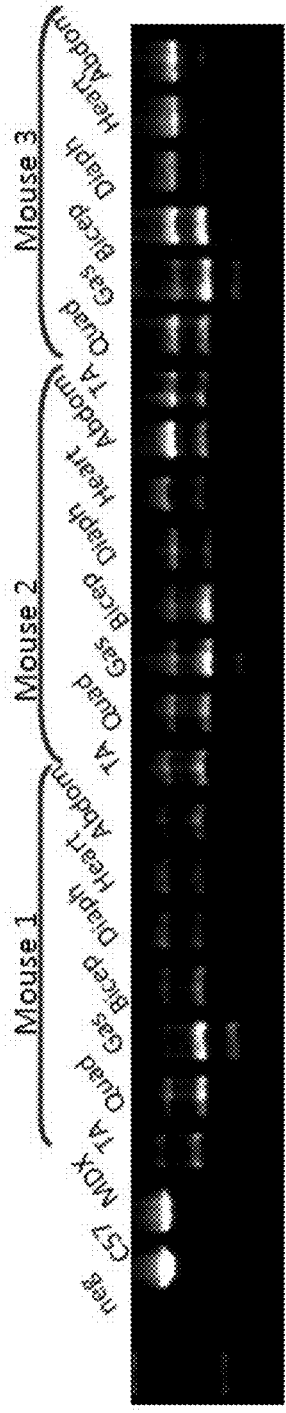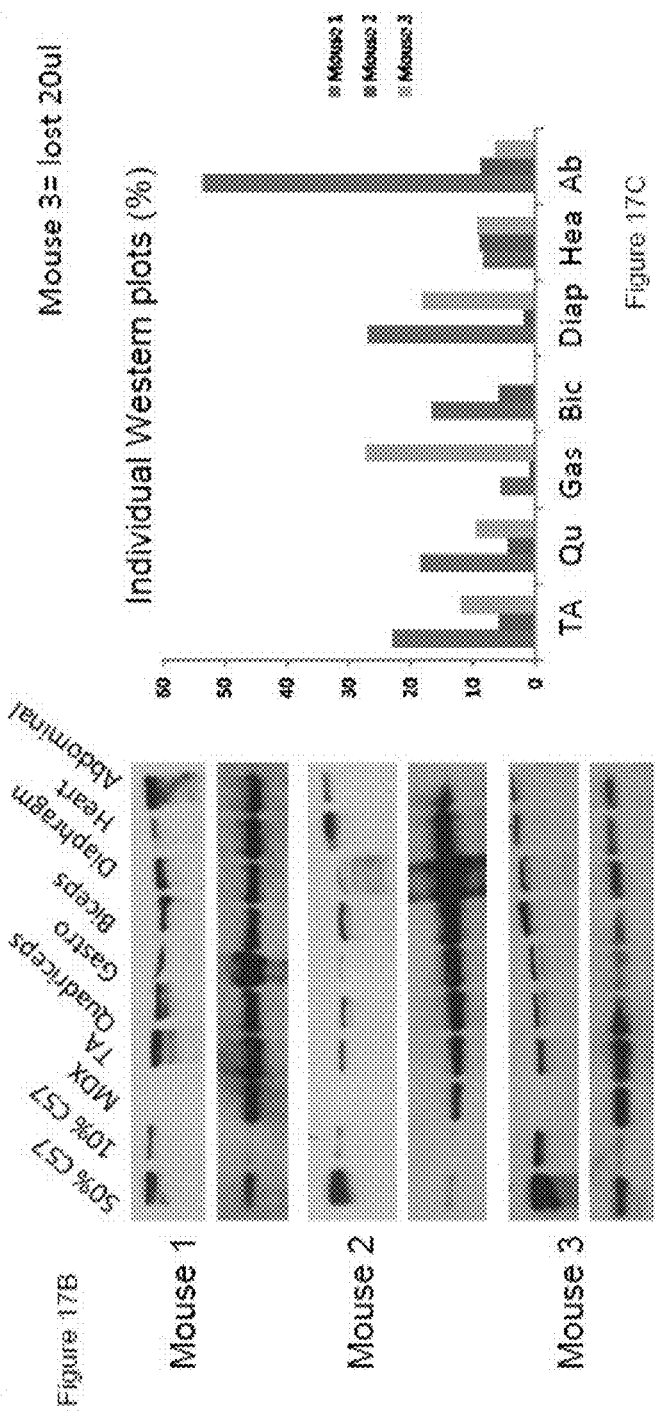
Figure 17A
Figure 17B
Figure 17C

| SEQ ID NO. | Name | Domain 1 | Domain 2 | Domain 3 | Length | No. Arg | No. X | No. B |
|---|---|---|---|---|---|---|---|---|
| 1 | Pip-5e | RXRRBRRXR | ILFQY | RXRBRXRB | 22 | 10 | 4 | 4 |
| | | | | | | | | |
| 2 | Pip-6a | RXRRBRRXR | YQFLI | RXRBRXRB | 22 | 10 | 4 | 3 |
| 3 | Pip-6b | RXRRBRRXR | IQFLI | RXRBRXRB | 22 | 10 | 4 | 3 |
| 4 | Pip-6c | RXRRBRRXR | QFLI | RXRBRXRB | 21 | 10 | 4 | 3 |
| 5 | Pip-6d | RXRRBRRXR | QFL | RXRBRXRB | 20 | 10 | 4 | 3 |
| 6 | Pip-6e | RXRRBRRX | YRFLI | RXRBRXRB | 21 | 10 | 4 | 3 |
| 7 | Pip-6f | RXRRBRRXR | FQILY | RXRBRXRB | 22 | 10 | 4 | 3 |
| 8 | Pip-6g | RXRRBRRX | YRFRLI | XRBRXRB | 21 | 10 | 4 | 3 |
| 9 | Pip-6h | RXRRBRRX | ILFRY | RXRBRXRB | 21 | 10 | 4 | 3 |
| 10 | Pip-6i | RXRRBRRXR | YQFLI | RXRBBRB | 21 | 10 | 3 | 3 |
| | | | | | | | | |
| 11 | Pip-7a | RXRRBBRX | YRFLI | XRBRXRB | 20 | 9 | 4 | 3 |
| 12 | Pip-7b | RXRRBRBX | YRFLI | XRBRXRB | 19 | 8 | 4 | 3 |
| 13 | Pip-7c | RXRBRX | YRFLI | XRBRXRB | 18 | 7 | 4 | 3 |
| 14 | Pip-7d | RXRBX | YRFLI | XRBRXRB | 17 | 6 | 4 | 3 |
| 15 | Pip-7b2 | RXRRBRRX | YRFLI | BRXRB | 18 | 8 | 3 | 3 |
| 16 | Pip-7c2 | RXRRBRX | YRFLI | BRXRB | 17 | 7 | 3 | 3 |
| | | | | | | | | |
| 17 | Pip-8a | RXRRBRXR | YQFLI | RXRRBRB | 20 | 9 | 3 | 3 |
| 18 | Pip-8b | RXRRBR | YQFLI | RXRRBRB | 18 | 8 | 2 | 3 |
| 19 | Pip-8c | RXRRBR | YQFLI | XRBRB | 17 | 7 | 2 | 3 |
| 20 | Pip-8c2 | RXRRBR | YQFLI | RRBRB | 16 | 7 | 1 | 3 |

X = aminohexanoic acid, B = betaAlanine, R = Arginine,    All peptides with N acetylated and C free carboxylic acid.

Figure 18

|  | SEQ ID NO. |  | SEQ ID NO. |
|---|---|---|---|
| RXRRBRRXRYQFLIRXRBRXRB | 21 | RXRBRXYQFLIRXRBRXRB | 39 |
| RXRRBRRXRYQFLIXRBRXRB | 22 | RXRBRXYQFLIXRBRXRB | 40 |
| RXRRBRRXRYQFLIRXRRBRB | 23 | RXRBRXYQFLIRXRRBRB | 41 |
| RXRRBRRXRYQFLIBRXRB | 24 | RXRBRXYQFLIBRXRB | 42 |
| RXRRBRRXRYQFLIXRRBRB | 25 | RXRBRXYQFLIXRRBRB | 43 |
| RXRRBRRXRYQFLIRRBRB | 26 | RXRBRXYQFLIRRBRB | 44 |
| RXRRBRRXRYQFLIXRBRB | 329 | RXRBRXYQFLIXRBRB | 351 |
| RXRRBRRXRYQFLIRBRXRB | 330 | RXRBRXYQFLIRBRXRB | 352 |
| RXRRBRRXRYQFLIRXRBRB | 331 | RXRBRXYQFLIRXRBRB | 353 |
| RXRRBRRXRYQFLIBRBRB | 332 | RXRBRXYQFLIBRBRB | 354 |
|  |  |  |  |
| RXRRBRRXYQFLIRXRBRXRB | 27 | RXRRBRXYQFLIRXRBRXRB | 45 |
| RXRRBRRXYQFLIXRBRXRB | 28 | RXRRBRXYQFLIXRBRXRB | 46 |
| RXRRBRRXYQFLIRXRRBRB | 29 | RXRRBRXYQFLIRXRRBRB | 47 |
| RXRRBRRXYQFLIBRXRB | 30 | RXRRBRXYQFLIBRXRB | 48 |
| RXRRBRRXYQFLIXRRBRB | 31 | RXRRBRXYQFLIXRRBRB | 49 |
| RXRRBRRXYQFLIRRBRB | 32 | RXRRBRXYQFLIRRBRB | 50 |
| RXRRBRRXYQFLIXRBRB | 333 | RXRRBRXYQFLIXRBRB | 355 |
| RXRRBRRXYQFLIRBRXRB | 334 | RXRRBRXYQFLIRBRXRB | 356 |
| RXRRBRRXYQFLIRXRBRB | 335 | RXRRBRXYQFLIRXRBRB | 357 |
| RXRRBRRXYQFLIBRBRB | 336 | RXRRBRXYQFLIBRBRB | 358 |
|  |  |  |  |
| RXRRBRXYQFLIRXRBRXRB | 33 | RXRRBRYQFLIRXRBRXRB | 51 |
| RXRRBRXYQFLIXRBRXRB | 34 | RXRRBRYQFLIXRBRXRB | 52 |
| RXRRBRXYQFLIRXRRBRB | 35 | RXRRBRYQFLIRXRRBRB | 53 |
| RXRRBRXYQFLIBRXRB | 36 | RXRRBRYQFLIBRXRB | 54 |
| RXRRBRXYQFLIXRRBRB | 37 | RXRRBRYQFLIXRRBRB | 55 |
| RXRRBRXYQFLIRRBRB | 38 | RXRRBRYQFLIRRBRB | 56 |
| RXRRBRXYQFLIXRBRB | 337 | RXRRBRYQFLIXRBRB | 359 |
| RXRRBRXYQFLIRBRXRB | 338 | RXRRBRYQFLIRBRXRB | 360 |
| RXRRBRXYQFLIRXRBRB | 339 | RXRRBRYQFLIRXRBRB | 361 |
| RXRRBRXYQFLIBRBRB | 340 | RXRRBRYQFLIBRBRB | 362 |
|  |  |  |  |
| RXRRBYQFLIRXRBRXRB | 341 | RXRRBRRYQFLIRXRBRXRB | 363 |
| RXRRBYQFLIXRBRXRB | 342 | RXRRBRRYQFLIXRBRXRB | 364 |
| RXRRBYQFLIRXRRBRB | 343 | RXRRBRRYQFLIRXRRBRB | 365 |
| RXRRBYQFLIBRXRB | 344 | RXRRBRRYQFLIBRXRB | 366 |
| RXRRBYQFLIXRRBRB | 345 | RXRRBRRYQFLIXRRBRB | 367 |
| RXRRBYQFLIRRBRB | 346 | RXRRBRRYQFLIRRBRB | 368 |
| RXRRBYQFLIXRBRB | 347 | RXRRBRRYQFLIXRBRB | 369 |
| RXRRBYQFLIRBRXRB | 348 | RXRRBRRYQFLIRBRXRB | 370 |
| RXRRBYQFLIRXRBRB | 349 | RXRRBRRYQFLIRXRBRB | 371 |
| RXRRBYQFLIBRBRB | 350 | RXRRBRRYQFLIBRBRB | 372 |
|  |  |  |  |
| RXRBXYQFLIRXRBRXRB | 373 |  |  |
| RXRBXYQFLIXRBRXRB | 374 |  |  |
| RXRBXYQFLIRXRRBRB | 375 |  |  |

Figure 23A

| | | | |
|---|---|---|---|
| RXRBXYQFLIBRXRB | 376 | | |
| RXRBXYQFLIXRRBRB | 377 | | |
| RXRBXYQFLIRRBRB | 378 | | |
| RXRBXYQFLIXRBRB | 379 | | |
| RXRBXYQFLIRBRXRB | 380 | | |
| RXRBXYQFLIRXRBRB | 381 | | |
| RXRBXYQFLIBRBRB | 382 | | |

X = any of aminohexanoic acid, aminobutyric acid, aminocaprylic acid, β-alanyl, p-aminobenzoyl, isonipecotyl, or 4-aminobutyryl,
B = betaAlanine
R = Arginine

Figure 23B

| | SEQ ID NO. | | SEQ ID NO. |
|---|---|---|---|
| RXRRBRRXRIQFLIRXRBRXRB | 57 | RXRBRXIQFLIRXRBRXRB | 75 |
| RXRRBRRXRIQFLIXRBRXRB | 58 | RXRBRXIQFLIXRBRXRB | 76 |
| RXRRBRRXRIQFLIRXRRBRB | 59 | RXRBRXIQFLIRXRRBRB | 77 |
| RXRRBRRXRIQFLIBRXRB | 60 | RXRBRXIQFLIBRXRB | 78 |
| RXRRBRRXRIQFLIXRRBRB | 61 | RXRBRXIQFLIXRRBRB | 79 |
| RXRRBRRXRIQFLIRRBRB | 62 | RXRBRXIQFLIRRBRB | 80 |
| RXRRBRRXRIQFLIXRBRB | 383 | RXRBRXIQFLIXRBRB | 415 |
| RXRRBRRXRIQFLIRBRXRB | 384 | RXRBRXIQFLIRBRXRB | 416 |
| RXRRBRRXRIQFLIRXRBRB | 385 | RXRBRXIQFLIRXRBRB | 417 |
| RXRRBRRXRIQFLIBRBRB | 386 | RXRBRXIQFLIBRBRB | 418 |
| | | | |
| RXRRBRRXIQFLIRXRBRXRB | 63 | RXRRBRXRIQFLIRXRBRXRB | 81 |
| RXRRBRRXIQFLIXRBRXRB | 64 | RXRRBRXRIQFLIXRBRXRB | 82 |
| RXRRBRRXIQFLIRXRRBRB | 65 | RXRRBRXRIQFLIRXRRBRB | 83 |
| RXRRBRRXIQFLIBRXRB | 66 | RXRRBRXRIQFLIBRXRB | 84 |
| RXRRBRRXIQFLIXRRBRB | 67 | RXRRBRXRIQFLIXRRBRB | 85 |
| RXRRBRRXIQFLIRRBRB | 68 | RXRRBRXRIQFLIRRBRB | 86 |
| RXRRBRRXIQFLIXRBRB | 387 | RXRRBRXRIQFLIXRBRB | 419 |
| RXRRBRRXIQFLIRBRXRB | 388 | RXRRBRXRIQFLIRBRXRB | 420 |
| RXRRBRRXIQFLIRXRBRB | 389 | RXRRBRXRIQFLIRXRBRB | 421 |
| RXRRBRRXIQFLIBRBRB | 390 | RXRRBRXRIQFLIBRBRB | 422 |
| | | | |
| RXRRBRXIQFLIRXRBRXRB | 69 | RXRRBRIQFLIRXRBRXRB | 87 |
| RXRRBRXIQFLIXRBRXRB | 70 | RXRRBRIQFLIXRBRXRB | 88 |
| RXRRBRXIQFLIRXRRBRB | 71 | RXRRBRIQFLIRXRRBRB | 89 |
| RXRRBRXIQFLIBRXRB | 72 | RXRRBRIQFLIBRXRB | 90 |
| RXRRBRXIQFLIXRRBRB | 73 | RXRRBRIQFLIXRRBRB | 91 |
| RXRRBRXIQFLIRRBRB | 74 | RXRRBRIQFLIRRBRB | 92 |
| RXRRBRXIQFLIXRBRB | 391 | RXRRBRIQFLIXRBRB | 423 |
| RXRRBRXIQFLIRBRXRB | 392 | RXRRBRIQFLIRBRXRB | 424 |
| RXRRBRXIQFLIRXRBRB | 393 | RXRRBRIQFLIRXRBRB | 425 |
| RXRRBRXIQFLIBRBRB | 394 | RXRRBRIQFLIBRBRB | 426 |
| | | | |
| RXRRBIQFLIRXRBRXRB | 395 | RXRRBRRIQFLIRXRBRXRB | 427 |
| RXRRBIQFLIXRBRXRB | 396 | RXRRBRRIQFLIXRBRXRB | 428 |
| RXRRBIQFLIRXRRBRB | 397 | RXRRBRRIQFLIRXRRBRB | 429 |
| RXRRBIQFLIBRXRB | 398 | RXRRBRRIQFLIBRXRB | 430 |
| RXRRBIQFLIXRRBRB | 399 | RXRRBRRIQFLIXRRBRB | 431 |
| RXRRBIQFLIRRBRB | 400 | RXRRBRRIQFLIRRBRB | 432 |
| RXRRBIQFLIXRBRB | 401 | RXRRBRRIQFLIXRBRB | 433 |
| RXRRBIQFLIRBRXRB | 402 | RXRRBRRIQFLIRBRXRB | 434 |
| RXRRBIQFLIRXRBRB | 403 | RXRRBRRIQFLIRXRBRB | 435 |
| RXRRBIQFLIBRBRB | 404 | RXRRBRRIQFLIBRBRB | 436 |
| | | | |
| RXRBXIQFLIRXRBRXRB | 405 | | |
| RXRBXIQFLIXRBRXRB | 406 | | |
| RXRBXIQFLIRXRRBRB | 407 | | |
| RXRBXIQFLIBRXRB | 408 | | |

Figure 24A

| | | | |
|---|---|---|---|
| RXRBXIQFLIXRRBRB | 409 | | |
| RXRBXIQFLIRRBRB | 410 | | |
| RXRBXIQFLIXRBRB | 411 | | |
| RXRBXIQFLIRBRXRB | 412 | | |
| RXRBXIQFLIRXRBRB | 413 | | |
| RXRBXIQFLIBRBRB | 414 | | |

X = any of aminohexanoic acid, aminobutyric acid, aminocaprylic acid, β-alanyl, p-aminobenzoyl, isonipecotyl, or 4-aminobutyryl,
B = betaAlanine
R = Arginine

Figure 24B

|  | SEQ ID NO. |  | SEQ ID NO. |
|---|---|---|---|
| RXRRBRRXRQFLIRXBRXRB | 93 | RXRBRXQFLIRXBRXRB | 111 |
| RXRRBRRXRQFLIXRBRXRB | 94 | RXRBRXQFLIXRBRXRB | 112 |
| RXRRBRRXRQFLIRXRRBRB | 95 | RXRBRXQFLIRXRRBRB | 113 |
| RXRRBRRXRQFLIBRXRB | 96 | RXRBRXQFLIBRXRB | 114 |
| RXRRBRRXRQFLIXRRBRB | 97 | RXRBRXQFLIXRRBRB | 115 |
| RXRRBRRXRQFLIRRBRB | 98 | RXRBRXQFLIRRBRB | 116 |
| RXRRBRRXRQFLIXRBRB | 437 | RXRBRXQFLIXRBRB | 470 |
| RXRRBRRXRQFLIRBRXRB | 438 | RXRBRXQFLIRBRXRB | 471 |
| RXRRBRRXRQFLIRXBRB | 439 | RXRBRXQFLIRXBRB | 472 |
| RXRRBRRXRQFLIBRBRB | 440 | RXRBRXQFLIBRBRB | 473 |
|  |  |  |  |
| RXRRBRRXQFLIRXBRXRB | 99 | RXRRBRXRQFLIRXBRXRB | 117 |
| RXRRBRRXQFLIXRBRXRB | 100 | RXRRBRXRQFLIXRBRXRB | 118 |
| RXRRBRRXQFLIRXRRBRB | 101 | RXRRBRXRQFLIRXRRBRB | 119 |
| RXRRBRRXQFLIBRXRB | 102 | RXRRBRXRQFLIBRXRB | 120 |
| RXRRBRRXQFLIXRRBRB | 103 | RXRRBRXRQFLIXRRBRB | 121 |
| RXRRBRRXQFLIRRBRB | 104 | RXRRBRXRQFLIRRBRB | 122 |
| RXRRBRRXQFLIXRBRB | 441 | RXRRBRXRQFLIXRBRB | 474 |
| RXRRBRRXQFLIRBRXRB | 442 | RXRRBRXRQFLIRBRXRB | 475 |
| RXRRBRRXQFLIRXBRB | 443 | RXRRBRXRQFLIRXBRB | 476 |
| RXRRBRRXQFLIBRBRB | 444 | RXRRBRXRQFLIBRBRB | 477 |
|  |  |  |  |
| RXRRBRXQFLIRXBRXRB | 105 | RXRRBRQFLIRXBRXRB | 123 |
| RXRRBRXQFLIXRBRXRB | 106 | RXRRBRQFLIXRBRXRB | 124 |
| RXRRBRXQFLIRXRRBRB | 107 | RXRRBRQFLIRXRRBRB | 125 |
| RXRRBRXQFLIBRXRB | 108 | RXRRBRQFLIBRXRB | 126 |
| RXRRBRXQFLIXRRBRB | 109 | RXRRBRQFLIXRRBRB | 127 |
| RXRRBRXQFLIRRBRB | 110 | RXRRBRQFLIRRBRB | 128 |
| RXRRBRXQFLIXRBRB | 445 | RXRRBRQFLIXRBRB | 478 |
| RXRRBRXQFLIRBRXRB | 446 | RXRRBRQFLIRBRXRB | 479 |
| RXRRBRXQFLIRXBRB | 447 | RXRRBRQFLIRXBRB | 480 |
| RXRRBRXQFLIBRBRB | 448 | RXRRBRQFLIBRBRB | 481 |
|  |  |  |  |
| RXRRBQFLIRXBRXRB | 449 | RXRRBRRQFLIRXBRXRB | 482 |
| RXRRBQFLIXRBRXRB | 450 | RXRRBRRQFLIXRBRXRB | 483 |
| RXRRBQFLIRXRRBRB | 451 | RXRRBRRQFLIRXRRBRB | 484 |
| RXRRBQFLIBRXRB | 452 | RXRRBRRQFLIBRXRB | 485 |
| RXRRBQFLIXRRBRB | 453 | RXRRBRRQFLIXRRBRB | 486 |
| RXRRBQFLIRRBRB | 454 | RXRRBRRQFLIRRBRB | 487 |
| RXRRBQFLIXRBRB | 456 | RXRRBRRQFLIXRBRB | 488 |
| RXRRBQFLIRBRXRB | 457 | RXRRBRRQFLIRBRXRB | 489 |
| RXRRBQFLIRXBRB | 458 | RXRRBRRQFLIRXBRB | 490 |
| RXRRBQFLIBRBRB | 459 | RXRRBRRQFLIBRBRB | 491 |
|  |  |  |  |
| RXRBXQFLIRXBRXRB | 460 |  |  |
| RXRBXQFLIXRBRXRB | 461 |  |  |
| RXRBXQFLIRXRRBRB | 462 |  |  |
| RXRBXQFLIBRXRB | 463 |  |  |

Figure 25A

| | | | |
|---|---|---|---|
| RXRBXQFLIXRRBRB | 464 | | |
| RXRBXQFLIRRBRB | 465 | | |
| RXRBXQFLIXRBRB | 466 | | |
| RXRBXQFLIRBRXRB | 467 | | |
| RXRBXQFLIRXRBRB | 468 | | |
| RXRBXQFLIBRBRB | 469 | | |

X = any of aminohexanoic acid, aminobutyric acid, aminocaprylic acid, β-alanyl, p-aminobenzoyl, isonipecotyl, or 4-aminobutyryl,
B = betaAlanine
R = Arginine

Figure 25B

|  | SEQ ID NO. |  | SEQ ID NO. |
|---|---|---|---|
| RXRRBRRXRQFLRXRBRXRB | 129 | RXRBRXQFLRXRBRXRB | 147 |
| RXRRBRRXRQFLXRBRXRB | 130 | RXRBRXQFLXRBRXRB | 148 |
| RXRRBRRXRQFLRXRRBRB | 131 | RXRBRXQFLRXRRBRB | 149 |
| RXRRBRRXRQFLBRXRB | 132 | RXRBRXQFLBRXRB | 150 |
| RXRRBRRXRQFLXRRBRB | 133 | RXRBRXQFLXRRBRB | 151 |
| RXRRBRRXRQFLRRBRB | 134 | RXRBRXQFLRRBRB | 152 |
| RXRRBRRXRQFLXRBRB | 492 | RXRBRXQFLXRBRB | 524 |
| RXRRBRRXRQFLRBRXRB | 493 | RXRBRXQFLRBRXRB | 525 |
| RXRRBRRXRQFLRXRBRB | 494 | RXRBRXQFLRXRBRB | 526 |
| RXRRBRRXRQFLBRBRB | 495 | RXRBRXQFLBRBRB | 527 |
|  |  |  |  |
| RXRRBRRXQFLRXRBRXRB | 135 | RXRRBRXRQFLRXRBRXRB | 153 |
| RXRRBRRXQFLXRBRXRB | 136 | RXRRBRXRQFLXRBRXRB | 154 |
| RXRRBRRXQFLRXRRBRB | 137 | RXRRBRXRQFLRXRRBRB | 155 |
| RXRRBRRXQFLBRXRB | 138 | RXRRBRXRQFLBRXRB | 156 |
| RXRRBRRXQFLXRRBRB | 139 | RXRRBRXRQFLXRRBRB | 157 |
| RXRRBRRXQFLRRBRB | 140 | RXRRBRXRQFLRRBRB | 158 |
| RXRRBRRXQFLXRBRB | 496 | RXRRBRXRQFLXRBRB | 528 |
| RXRRBRRXQFLRBRXRB | 497 | RXRRBRXRQFLRBRXRB | 529 |
| RXRRBRRXQFLRXRBRB | 498 | RXRRBRXRQFLRXRBRB | 530 |
| RXRRBRRXQFLBRBRB | 499 | RXRRBRXRQFLBRBRB | 531 |
|  |  |  |  |
| RXRRBRXQFLRXRBRXRB | 141 | RXRRBRQFLRXRBRXRB | 159 |
| RXRRBRXQFLXRBRXRB | 142 | RXRRBRQFLXRBRXRB | 160 |
| RXRRBRXQFLRXRRBRB | 143 | RXRRBRQFLRXRRBRB | 161 |
| RXRRBRXQFLBRXRB | 144 | RXRRBRQFLBRXRB | 162 |
| RXRRBRXQFLXRRBRB | 145 | RXRRBRQFLXRRBRB | 163 |
| RXRRBRXQFLRRBRB | 146 | RXRRBRQFLRRBRB | 164 |
| RXRRBRXQFLXRBRB | 500 | RXRRBRQFLXRBRB | 532 |
| RXRRBRXQFLRBRXRB | 501 | RXRRBRQFLRBRXRB | 533 |
| RXRRBRXQFLRXRBRB | 502 | RXRRBRQFLRXRBRB | 534 |
| RXRRBRXQFLBRBRB | 503 | RXRRBRQFLBRBRB | 535 |
|  |  |  |  |
| RXRRBQFLRXRBRXRB | 504 | RXRRBRRQFLRXRBRXRB | 536 |
| RXRRBQFLXRBRXRB | 505 | RXRRBRRQFLXRBRXRB | 537 |
| RXRRBQFLRXRRBRB | 506 | RXRRBRRQFLRXRRBRB | 538 |
| RXRRBQFLBRXRB | 507 | RXRRBRRQFLBRXRB | 539 |
| RXRRBQFLXRRBRB | 508 | RXRRBRRQFLXRRBRB | 540 |
| RXRRBQFLRRBRB | 509 | RXRRBRRQFLRRBRB | 541 |
| RXRRBQFLXRBRB | 510 | RXRRBRRQFLXRBRB | 542 |
| RXRRBQFLRBRXRB | 511 | RXRRBRRQFLRBRXRB | 543 |
| RXRRBQFLRXRBRB | 512 | RXRRBRRQFLRXRBRB | 544 |
| RXRRBQFLBRBRB | 513 | RXRRBRRQFLBRBRB | 545 |
|  |  |  |  |
| RXRBXQFLRXRBRXRB | 514 |  |  |
| RXRBXQFLXRBRXRB | 515 |  |  |
| RXRBXQFLRXRRBRB | 516 |  |  |
| RXRBXQFLBRXRB | 517 |  |  |

Figure 26A

| | | | |
|---|---|---|---|
| RXRBXQFLXRRBRB | 518 | | |
| RXRBXQFLRRBRB | 519 | | |
| RXRBXQFLXRBRB | 520 | | |
| RXRBXQFLRBRXRB | 521 | | |
| RXRBXQFLRXRBRB | 522 | | |
| RXRBXQFLBRBRB | 523 | | |

X = any of aminohexanoic acid, aminobutyric acid, aminocaprylic acid, β-alanyl, p-aminobenzoyl, isonipecotyl, or 4-aminobutyryl,
B = betaAlanine
R = Arginine

Figure 26B

| | SEQ ID NO. | | SEQ ID NO. |
|---|---|---|---|
| RXRRBRRXRYRFLIRXRBRXRB | 165 | RXRBRXYRFLIRXRBRXRB | 183 |
| RXRRBRRXRYRFLIXRBRXRB | 166 | RXRBRXYRFLIXRBRXRB | 184 |
| RXRRBRRXRYRFLIRXRRBRB | 167 | RXRBRXYRFLIRXRRBRB | 185 |
| RXRRBRRXRYRFLIBRXRB | 168 | RXRBRXYRFLIBRXRB | 186 |
| RXRRBRRXRYRFLIXRRBRB | 169 | RXRBRXYRFLIXRRBRB | 187 |
| RXRRBRRXRYRFLIRRBRB | 170 | RXRBRXYRFLIRRBRB | 188 |
| RXRRBRRXRYRFLIXRBRB | 546 | RXRBRXYRFLIXRBRB | 578 |
| RXRRBRRXRYRFLIRBRXRB | 547 | RXRBRXYRFLIRBRXRB | 579 |
| RXRRBRRXRYRFLIRXRBRB | 548 | RXRBRXYRFLIRXRBRB | 580 |
| RXRRBRRXRYRFLIBRBRB | 549 | RXRBRXYRFLIBRBRB | 581 |
| | | | |
| RXRRBRRXYRFLIRXRBRXRB | 171 | RXRRBRXRYRFLIRXRBRXRB | 189 |
| RXRRBRRXYRFLIXRBRXRB | 172 | RXRRBRXRYRFLIXRBRXRB | 190 |
| RXRRBRRXYRFLIRXRRBRB | 173 | RXRRBRXRYRFLIRXRRBRB | 191 |
| RXRRBRRXYRFLIBRXRB | 174 | RXRRBRXRYRFLIBRXRB | 192 |
| RXRRBRRXYRFLIXRRBRB | 175 | RXRRBRXRYRFLIXRRBRB | 193 |
| RXRRBRRXYRFLIRRBRB | 176 | RXRRBRXRYRFLIRRBRB | 194 |
| RXRRBRRXYRFLIXRBRB | 550 | RXRRBRXRYRFLIXRBRB | 582 |
| RXRRBRRXYRFLIRBRXRB | 551 | RXRRBRXRYRFLIRBRXRB | 583 |
| RXRRBRRXYRFLIRXRBRB | 552 | RXRRBRXRYRFLIRXRBRB | 584 |
| RXRRBRRXYRFLIBRBRB | 553 | RXRRBRXRYRFLIBRBRB | 585 |
| | | | |
| RXRRBRXYRFLIRXRBRXRB | 177 | RXRRBRYRFLIRXRBRXRB | 195 |
| RXRRBRXYRFLIXRBRXRB | 178 | RXRRBRYRFLIXRBRXRB | 196 |
| RXRRBRXYRFLIRXRRBRB | 179 | RXRRBRYRFLIRXRRBRB | 197 |
| RXRRBRXYRFLIBRXRB | 180 | RXRRBRYRFLIBRXRB | 198 |
| RXRRBRXYRFLIXRRBRB | 181 | RXRRBRYRFLIXRRBRB | 199 |
| RXRRBRXYRFLIRRBRB | 182 | RXRRBRYRFLIRRBRB | 200 |
| RXRRBRXYRFLIXRBRB | 554 | RXRRBRYRFLIXRBRB | 586 |
| RXRRBRXYRFLIRBRXRB | 555 | RXRRBRYRFLIRBRXRB | 587 |
| RXRRBRXYRFLIRXRBRB | 556 | RXRRBRYRFLIRXRBRB | 588 |
| RXRRBRXYRFLIBRBRB | 557 | RXRRBRYRFLIBRBRB | 589 |
| | | | |
| RXRRBYRFLIRXRBRXRB | 558 | RXRRBRRYRFLIRXRBRXRB | 590 |
| RXRRBYRFLIXRBRXRB | 559 | RXRRBRRYRFLIXRBRXRB | 591 |
| RXRRBYRFLIRXRRBRB | 560 | RXRRBRRYRFLIRXRRBRB | 592 |
| RXRRBYRFLIBRXRB | 561 | RXRRBRRYRFLIBRXRB | 593 |
| RXRRBYRFLIXRRBRB | 562 | RXRRBRRYRFLIXRRBRB | 594 |
| RXRRBYRFLIRRBRB | 563 | RXRRBRRYRFLIRRBRB | 595 |
| RXRRBYRFLIXRBRB | 564 | RXRRBRRYRFLIXRBRB | 596 |
| RXRRBYRFLIRBRXRB | 565 | RXRRBRRYRFLIRBRXRB | 597 |
| RXRRBYRFLIRXRBRB | 566 | RXRRBRRYRFLIRXRBRB | 598 |
| RXRRBYRFLIBRBRB | 567 | RXRRBRRYRFLIBRBRB | 599 |
| | | | |
| RXRBXYRFLIRXRBRXRB | 568 | | |
| RXRBXYRFLIXRBRXRB | 569 | | |
| RXRBXYRFLIRXRRBRB | 570 | | |
| RXRBXYRFLIBRXRB | 571 | | |

Figure 27A

| | | | |
|---|---|---|---|
| RXRBXYRFLIXRRBRB | 572 | | |
| RXRBXYRFLIRRBRB | 573 | | |
| RXRBXYRFLIXRBRB | 574 | | |
| RXRBXYRFLIRBRXRB | 575 | | |
| RXRBXYRFLIRXRBRB | 576 | | |
| RXRBXYRFLIBRBRB | 577 | | |

X = any of aminohexanoic acid, aminobutyric acid, aminocaprylic acid, β-alanyl, p-aminobenzoyl, isonipecotyl, or 4-aminobutyryl,
B = betaAlanine
R = Arginine

Figure 27B

|  | SEQ ID NO. |  | SEQ ID NO. |
|---|---|---|---|
| RXRRBRRXRFQILYRXBRXRB | 201 | RXRBRXFQILYRXBRXRB | 219 |
| RXRRBRRXRFQILYXBRXRB | 202 | RXRBRXFQILYXBRXRB | 220 |
| RXRRBRRXRFQILYRXRRBRB | 203 | RXRBRXFQILYRXRRBRB | 221 |
| RXRRBRRXRFQILYBRXRB | 204 | RXRBRXFQILYBRXRB | 222 |
| RXRRBRRXRFQILYXRRBRB | 205 | RXRBRXFQILYXRRBRB | 223 |
| RXRRBRRXRFQILYRRBRB | 206 | RXRBRXFQILYRRBRB | 224 |
| RXRRBRRXRFQILYXRBRB | 600 | RXRBRXFQILYXRBRB | 632 |
| RXRRBRRXRFQILYRBRXRB | 601 | RXRBRXFQILYRBRXRB | 633 |
| RXRRBRRXRFQILYRXBRB | 602 | RXRBRXFQILYRXBRB | 634 |
| RXRRBRRXRFQILYBRBRB | 603 | RXRBRXFQILYBRBRB | 635 |
|  |  |  |  |
| RXRRBRRXFQILYRXBRXRB | 207 | RXRRBRXRFQILYRXBRXRB | 225 |
| RXRRBRRXFQILYXBRXRB | 208 | RXRRBRXRFQILYXBRXRB | 226 |
| RXRRBRRXFQILYRXRRBRB | 209 | RXRRBRXRFQILYRXRRBRB | 227 |
| RXRRBRRXFQILYBRXRB | 210 | RXRRBRXRFQILYBRXRB | 228 |
| RXRRBRRXFQILYXRRBRB | 211 | RXRRBRXRFQILYXRRBRB | 229 |
| RXRRBRRXFQILYRRBRB | 212 | RXRRBRXRFQILYRRBRB | 230 |
| RXRRBRRXFQILYXBRB | 604 | RXRRBRXRFQILYXBRB | 636 |
| RXRRBRRXFQILYRBRXRB | 605 | RXRRBRXRFQILYRBRXRB | 637 |
| RXRRBRRXFQILYRXBRB | 606 | RXRRBRXRFQILYRXBRB | 638 |
| RXRRBRRXFQILYBRBRB | 607 | RXRRBRXRFQILYBRBRB | 639 |
|  |  |  |  |
| RXRRBRXFQILYRXBRXRB | 213 | RXRRBRFQILYRXBRXRB | 231 |
| RXRRBRXFQILYXBRXRB | 214 | RXRRBRFQILYXBRXRB | 232 |
| RXRRBRXFQILYRXRRBRB | 215 | RXRRBRFQILYRXRRBRB | 233 |
| RXRRBRXFQILYBRXRB | 216 | RXRRBRFQILYBRXRB | 234 |
| RXRRBRXFQILYXRRBRB | 217 | RXRRBRFQILYXRRBRB | 235 |
| RXRRBRXFQILYRRBRB | 218 | RXRRBRFQILYRRBRB | 236 |
| RXRRBRXFQILYXBRB | 608 | RXRRBRFQILYXBRB | 640 |
| RXRRBRXFQILYRBRXRB | 609 | RXRRBRFQILYRBRXRB | 641 |
| RXRRBRXFQILYRXBRB | 610 | RXRRBRFQILYRXBRB | 642 |
| RXRRBRXFQILYBRBRB | 611 | RXRRBRFQILYBRBRB | 643 |
|  |  |  |  |
| RXRRBFQILYRXBRXRB | 612 | RXRRBRRFQILYRXBRXRB | 644 |
| RXRRBFQILYXBRXRB | 613 | RXRRBRRFQILYXBRXRB | 645 |
| RXRRBFQILYRXRRBRB | 614 | RXRRBRRFQILYRXRRBRB | 646 |
| RXRRBFQILYBRXRB | 615 | RXRRBRRFQILYBRXRB | 647 |
| RXRRBFQILYXRRBRB | 616 | RXRRBRRFQILYXRRBRB | 648 |
| RXRRBFQILYRRBRB | 617 | RXRRBRRFQILYRRBRB | 649 |
| RXRRBFQILYXBRB | 618 | RXRRBRRFQILYXBRB | 650 |
| RXRRBFQILYRBRXRB | 619 | RXRRBRRFQILYRBRXRB | 651 |
| RXRRBFQILYRXBRB | 620 | RXRRBRRFQILYRXBRB | 652 |
| RXRRBFQILYBRBRB | 621 | RXRRBRRFQILYBRBRB | 653 |
|  |  |  |  |
| RXRBXFQILYRXBRXRB

| | | | |
|---|---|---|---|
| RXRBXFQILYXRRBRB | 626 | | |
| RXRBXFQILYRRBRB | 627 | | |
| RXRBXFQILYXRBRB | 628 | | |
| RXRBXFQILYRBRXRB | 629 | | |
| RXRBXFQILYRXRBRB | 630 | | |
| RXRBXFQILYBRBRB | 631 | | |

X = any of aminohexanoic acid, aminobutyric acid, aminocaprylic acid, β-alanyl, p-aminobenzoyl, isonipecotyl, or 4-aminobutyryl,
B = betaAlanine
R = Arginine

Figure 28B

| | SEQ ID NO. | | SEQ ID NO. |
|---|---|---|---|
| RXRRBRRXRYRFRLIRXRBRXRB | 237 | RXRBRXYRFRLIRXRBRXRB | 255 |
| RXRRBRRXRYRFRLIXRBRXRB | 238 | RXRBRXYRFRLIXRBRXRB | 256 |
| RXRRBRRXRYRFRLIRXRRBRB | 239 | RXRBRXYRFRLIRXRRBRB | 257 |
| RXRRBRRXRYRFRLIBRXRB | 240 | RXRBRXYRFRLIBRXRB | 258 |
| RXRRBRRXRYRFRLIXRRBRB | 241 | RXRBRXYRFRLIXRRBRB | 259 |
| RXRRBRRXRYRFRLIRRBRB | 242 | RXRBRXYRFRLIRRBRB | 260 |
| RXRRBRRXRYRFRLIXRBRB | 654 | RXRBRXYRFRLIXRBRB | 686 |
| RXRRBRRXRYRFRLIRBRXRB | 655 | RXRBRXYRFRLIRBRXRB | 687 |
| RXRRBRRXRYRFRLIRXRBRB | 656 | RXRBRXYRFRLIRXRBRB | 688 |
| RXRRBRRXRYRFRLIBRBRB | 657 | RXRBRXYRFRLIBRBRB | 689 |
| | | | |
| RXRRBRRXYRFRLIRXRBRXRB | 243 | RXRRBRXRYRFRLIRXRBRXRB | 261 |
| RXRRBRRXYRFRLIXRBRXRB | 244 | RXRRBRXRYRFRLIXRBRXRB | 262 |
| RXRRBRRXYRFRLIRXRRBRB | 245 | RXRRBRXRYRFRLIRXRRBRB | 263 |
| RXRRBRRXYRFRLIBRXRB | 246 | RXRRBRXRYRFRLIBRXRB | 264 |
| RXRRBRRXYRFRLIXRRBRB | 247 | RXRRBRXRYRFRLIXRRBRB | 265 |
| RXRRBRRXYRFRLIRRBRB | 248 | RXRRBRXRYRFRLIRRBRB | 266 |
| RXRRBRRXYRFRLIXRBRB | 658 | RXRRBRXRYRFRLIXRBRB | 690 |
| RXRRBRRXYRFRLIRBRXRB | 659 | RXRRBRXRYRFRLIRBRXRB | 691 |
| RXRRBRRXYRFRLIRXRBRB | 660 | RXRRBRXRYRFRLIRXRBRB | 692 |
| RXRRBRRXYRFRLIBRBRB | 661 | RXRRBRXRYRFRLIBRBRB | 693 |
| | | | |
| RXRRBRXYRFRLIRXRBRXRB | 249 | RXRRBRYRFRLIRXRBRXRB | 267 |
| RXRRBRXYRFRLIXRBRXRB | 250 | RXRRBRYRFRLIXRBRXRB | 268 |
| RXRRBRXYRFRLIRXRRBRB | 251 | RXRRBRYRFRLIRXRRBRB | 269 |
| RXRRBRXYRFRLIBRXRB | 252 | RXRRBRYRFRLIBRXRB | 270 |
| RXRRBRXYRFRLIXRRBRB | 253 | RXRRBRYRFRLIXRRBRB | 271 |
| RXRRBRXYRFRLIRRBRB | 254 | RXRRBRYRFRLIRRBRB | 272 |
| RXRRBRXYRFRLIXRBRB | 662 | RXRRBRYRFRLIXRBRB | 694 |
| RXRRBRXYRFRLIRBRXRB | 663 | RXRRBRYRFRLIRBRXRB | 695 |
| RXRRBRXYRFRLIRXRBRB | 664 | RXRRBRYRFRLIRXRBRB | 696 |
| RXRRBRXYRFRLIBRBRB | 665 | RXRRBRYRFRLIBRBRB | 697 |
| | | | |
| RXRRBYRFRLIRXRBRXRB | 666 | RXRRBRRYRFRLIRXRBRXRB | 698 |
| RXRRBYRFRLIXRBRXRB | 667 | RXRRBRRYRFRLIXRBRXRB | 699 |
| RXRRBYRFRLIRXRRBRB | 668 | RXRRBRRYRFRLIRXRRBRB | 700 |
| RXRRBYRFRLIBRXRB | 669 | RXRRBRRYRFRLIBRXRB | 701 |
| RXRRBYRFRLIXRRBRB | 670 | RXRRBRRYRFRLIXRRBRB | 702 |
| RXRRBYRFRLIRRBRB | 671 | RXRRBRRYRFRLIRRBRB | 703 |
| RXRRBYRFRLIXRBRB | 672 | RXRRBRRYRFRLIXRBRB | 704 |
| RXRRBYRFRLIRBRXRB | 673 | RXRRBRRYRFRLIRBRXRB | 705 |
| RXRRBYRFRLIRXRBRB | 674 | RXRRBRRYRFRLIRXRBRB | 706 |
| RXRRBYRFRLIBRBRB | 675 | RXRRBRRYRFRLIBRBRB | 707 |
| | | | |
| RXRBXYRFRLIRXRBRXRB | 676 | | |
| RXRBXYRFRLIXRBRXRB | 677 | | |
| RXRBXYRFRLIRXRRBRB | 678 | | |
| RXRBXYRFRLIBRXRB | 679 | | |

Figure 29A

| | | | |
|---|---|---|---|
| RXRBXYRFRLIXRRBRB | 680 | | |
| RXRBXYRFRLIRRBRB | 681 | | |
| RXRBXYRFRLIXRBRB | 682 | | |
| RXRBXYRFRLIRBRXRB | 683 | | |
| RXRBXYRFRLIRXRBRB | 684 | | |
| RXRBXYRFRLIBRBRB | 685 | | |

X = any of aminohexanoic acid, aminobutyric acid, aminocaprylic acid, β-alanyl, p-aminobenzoyl, isonipecotyl, or 4-aminobutyryl,
B = betaAlanine
R = Arginine

Figure 29B

| | SEQ ID NO. | | SEQ ID NO. |
|---|---|---|---|
| RXRRBRRXRILFRYRXRBRXRB | 273 | RXRBRXILFRYRXRBRXRB | 291 |
| RXRRBRRXRILFRYXRBRXRB | 274 | RXRBRXILFRYXRBRXRB | 292 |
| RXRRBRRXRILFRYXRRBRB | 275 | RXRBRXILFRYXRRBRB | 293 |
| RXRRBRRXRILFRYBRXRB | 276 | RXRBRXILFRYBRXRB | 294 |
| RXRRBRRXRILFRYXRRBRB | 277 | RXRBRXILFRYXRRBRB | 295 |
| RXRRBRRXRILFRYRRBRB | 278 | RXRBRXILFRYRRBRB | 296 |
| RXRRBRRXRILFRYXRBRB | 708 | RXRBRXILFRYXRBRB | 740 |
| RXRRBRRXRILFRYRBRXRB | 709 | RXRBRXILFRYBRXRB | 741 |
| RXRRBRRXRILFRYXRBRB | 710 | RXRBRXILFRYXRBRB | 742 |
| RXRRBRRXRILFRYBRBRB | 711 | RXRBRXILFRYBRBRB | 743 |
| | | | |
| RXRRBRRXILFRYRXRBRXRB | 279 | RXRRBRXRILFRYRXRBRXRB | 297 |
| RXRRBRRXILFRYXRBRXRB | 280 | RXRRBRXRILFRYXRBRXRB | 298 |
| RXRRBRRXILFRYXRRBRB | 281 | RXRRBRXRILFRYXRRBRB | 299 |
| RXRRBRRXILFRYBRXRB | 282 | RXRRBRXRILFRYBRXRB | 300 |
| RXRRBRRXILFRYXRRBRB | 283 | RXRRBRXRILFRYXRRBRB | 301 |
| RXRRBRRXILFRYRRBRB | 284 | RXRRBRXRILFRYRRBRB | 302 |
| RXRRBRRXILFRYXRBRB | 712 | RXRRBRXRILFRYXRBRB | 744 |
| RXRRBRRXILFRYBRXRB | 713 | RXRRBRXRILFRYBRXRB | 745 |
| RXRRBRRXILFRYXRBRB | 714 | RXRRBRXRILFRYXRBRB | 746 |
| RXRRBRRXILFRYBRBRB | 715 | RXRRBRXRILFRYBRBRB | 747 |
| | | | |
| RXRRBRXILFRYRXRBRXRB | 285 | RXRRBRILFRYRXRBRXRB | 303 |
| RXRRBRXILFRYXRBRXRB | 286 | RXRRBRILFRYXRBRXRB | 304 |
| RXRRBRXILFRYXRRBRB | 287 | RXRRBRILFRYXRRBRB | 305 |
| RXRRBRXILFRYBRXRB | 288 | RXRRBRILFRYBRXRB | 306 |
| RXRRBRXILFRYXRRBRB | 289 | RXRRBRILFRYXRRBRB | 307 |
| RXRRBRXILFRYRRBRB | 290 | RXRRBRILFRYRRBRB | 308 |
| RXRRBRXILFRYXRBRB | 716 | RXRRBRILFRYXRBRB | 748 |
| RXRRBRXILFRYBRXRB | 717 | RXRRBRILFRYBRXRB | 749 |
| RXRRBRXILFRYXRBRB | 718 | RXRRBRILFRYXRBRB | 750 |
| RXRRBRXILFRYBRBRB | 719 | RXRRBRILFRYBRBRB | 751 |
| | | | |
| RXRRBILFRYRXRBRXRB | 720 | RXRRBRRILFRYRXRBRXRB | 752 |
| RXRRBILFRYXRBRXRB | 721 | RXRRBRRILFRYXRBRXRB | 753 |
| RXRRBILFRYXRRBRB | 722 | RXRRBRRILFRYXRRBRB | 754 |
| RXRRBILFRYBRXRB | 723 | RXRRBRRILFRYBRXRB | 755 |
| RXRRBILFRYXRRBRB | 724 | RXRRBRRILFRYXRRBRB | 756 |
| RXRRBILFRYRRBRB | 725 | RXRRBRRILFRYRRBRB | 757 |
| RXRRBILFRYXRBRB | 726 | RXRRBRRILFRYXRBRB | 758 |
| RXRRBILFRYBRXRB | 727 | RXRRBRRILFRYBRXRB | 759 |
| RXRRBILFRYXRBRB | 728 | RXRRBRRILFRYXRBRB | 760 |
| RXRRBILFRYBRBRB | 729 | RXRRBRRILFRYBRBRB | 761 |
| | | | |
| RXRBXILFRYRXRBRXRB | 730 | | |
| RXRBXILFRYXRBRXRB | 731 | | |
| RXRBXILFRYXRRBRB | 732 | | |
| RXRBXILFRYBRXRB | 733 | | |

Figure 30A

| | | | |
|---|---|---|---|
| RXRBXILFRYXRRBRB | 734 | | |
| RXRBXILFRYRRBRB | 735 | | |
| RXRBXILFRYXRBRB | 736 | | |
| RXRBXILFRYRBRXRB | 737 | | |
| RXRBXILFRYRXRBRB | 738 | | |
| RXRBXILFRYBRBRB | 739 | | |

X = any of aminohexanoic acid, aminobutyric acid, aminocaprylic acid, β-alanyl, p-aminobenzoyl, isonipecotyl, or 4-aminobutyryl,
B = betaAlanine
R = Arginine

Figure 30B

| Relative to *mdx* | Quadriceps | | Diaphragm | | Heart | |
|---|---|---|---|---|---|---|
| C57 | **** | 0.0000 | **** | 0.0000 | **** | 0.0000 |
| Pip6a | **** | 0.0000 | **** | 0.0000 | **** | 0.0000 |
| Pip6b | **** | 0.0000 | **** | 0.0000 | **** | 0.0000 |
| Pip6c | ** | 0.0040 | **** | 0.0000 | N/S | 0.8787 |
| Pip6d | N/S | 0.0574 | * | 0.0155 | N/S | 0.7276 |
| Pip6e | **** | 0.0000 | **** | 0.0000 | N/S | 0.1150 |
| Pip6f | ** | 0.0018 | **** | 0.0000 | ** | 0.0016 |
| Pip5e | **** | 0.0000 | **** | 0.0000 | * | 0.0293 |

Figure 31

| Relative to Pip5e | Quadriceps | | Diaphragm | | Heart | |
|---|---|---|---|---|---|---|
| C57 | **** | 0.0000 | **** | 0.0000 | **** | 0.0000 |
| *mdx* | **** | 0.0000 | **** | 0.0000 | * | 0.0293 |
| Pip6a | N/S | 0.9573 | N/S | 1.0995 | * | 0.0366 |
| Pip6b | N/S | 1.1417 | N/S | 0.4750 | N/S | 0.0771 |
| Pip6c | N/S | 1.9032 | N/S | 1.5987 | N/S | 1.9797 |
| Pip6d | N/S | 1.9909 | N/S | 1.9965 | N/S | 1.9341 |
| Pip6e | N/S | 1.0558 | N/S | 1.6184 | N/S | 1.4561 |
| Pip6f | N/S | 1.8355 | N/S | 1.2249 | N/S | 0.3349 |

Figure 32

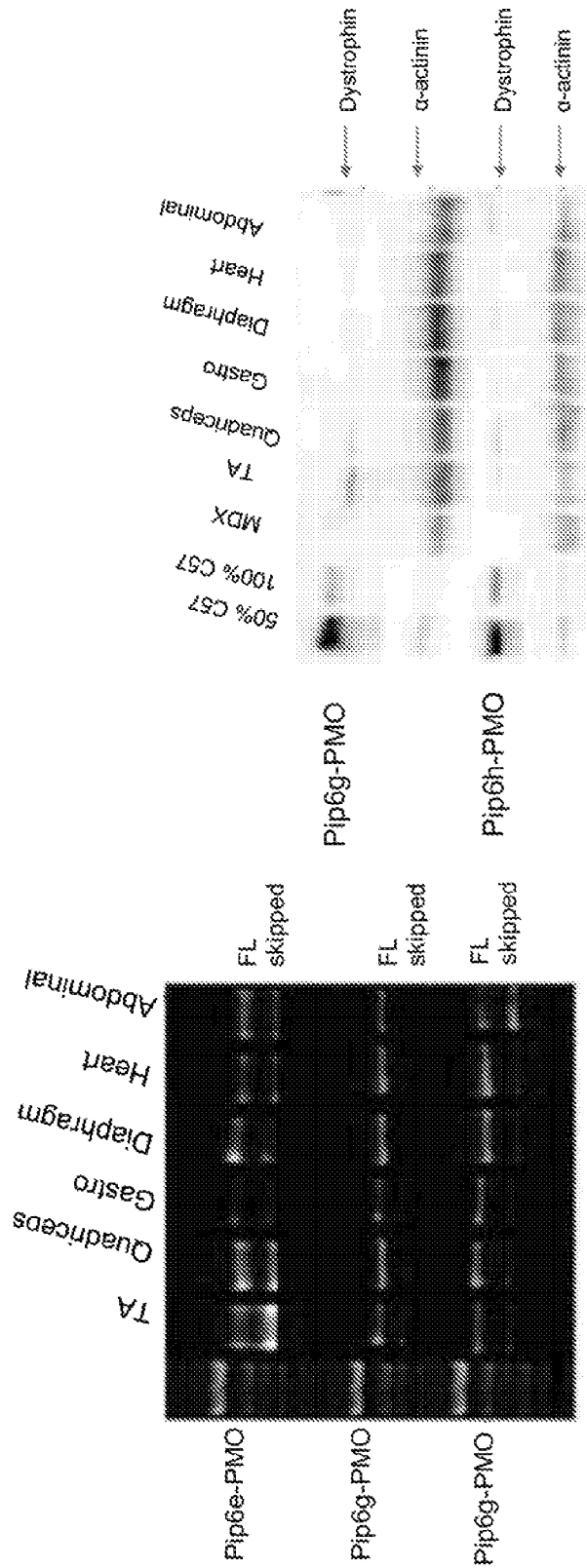

| Name | Calculated average mass | Observed average protonated mass* |
|---|---|---|
| Pip6a-PMO | 11346 | 11346 |
| Pip6b-PMO | 11298 | 11303 |
| Pip6c-PMO | 11184 | 11188 |
| Pip6d-PMO | 11071 | 11074 |
| Pip6e-PMO | 11220 | 11225 |
| Pip6f-PMO | 11348 | 11353 |
| Pip6g-PMO | 11220 | 11223 |
| Pip6h-PMO | 11220 | 11225 |
| Pip6e-PMO | 11348 | 11343 |

*Observed mass accuracy ± 0.05% of calculated mass.

Figure 37C

| qRT-PCR mean values (%) | Quadriceps | Diaphragm | Heart |
|---|---|---|---|
| Pip6a | 15.98 | 8.80 | 5.43 |
| Pip6b | 14.33 | 7.38 | 8.00 |
| Pip6c | 10.25 | 8.81 | 1.26 |
| Pip6d | 7.29 | 5.08 | 1.39 |
| Pip6e | 14.37 | 9.18 | 7.81 |
| Pip6f | 13.89 | 11.66 | 9.58 |
| Pip5e | 12.00 | 18.36 | 5.89 |

| Relative to mdx | Quadriceps | | Diaphragm | | Heart | |
|---|---|---|---|---|---|---|
| C57 | **** | 0.0000 | **** | 0.0000 | **** | 0.0000 |
| Pip6e | **** | 0.0000 | **** | 0.0000 | N/S | 0.0860 |
| Pip6g | N/S | 0.3570 | N/S | 0.0808 | N/S | 0.6100 |
| Pip6h | * | 0.0294 | *** | 0.0004 | N/S | 0.6180 |

Figure 39A

| Relative to Pip6e | Quadriceps | | Diaphragm | | Heart | |
|---|---|---|---|---|---|---|
| C57 | **** | 0.0000 | **** | 0.0000 | **** | 0.0000 |
| mdx | **** | 0.0000 | **** | 0.0000 | N/S | 0.0836 |
| Pip6g | **** | 0.0000 | *** | 0.0003 | * | 0.0258 |
| Pip6h | ** | 0.0078 | N/S | 0.0630 | N/S | 0.2150 |

Figure 39B

| qRT-PCR mean values | Quadriceps | Diaphragm | Heart |
|---|---|---|---|
| Pip6e | 14.37 | 9.18 | 6.92 |
| Pip6g | 2.41 | 3.86 | 2.25 |
| Pip6h | 5.11 | 4.68 | 3.10 |

Figure 39C

| SEQ ID NO. | Name | Domain 1 | Domain 2 | Domain 3 | Length | No. Arg | No. X | No. B |
|---|---|---|---|---|---|---|---|---|
| 317 | Pip-8d | RXRRBR | YQFLI | BRXRB | 16 | 6 | 2 | 3 |
| 318 | Pip-8d2 | RXRRBR | YQFLI | XRBRB | 16 | 6 | 2 | 3 |
| 319 | Pip-8d3 | RXRRB | YQFLI | XRRBRB | 16 | 6 | 2 | 3 |
| | | | | | | | | |
| 320 | Pip-9b | RXRRBR | FQILY | RXRRBRB | 18 | 8 | 2 | 3 |
| 321 | Pip-9b2 | RXRRBRR | FQILY | RBRXRB | 18 | 8 | 2 | 3 |
| 322 | Pip-9c | RXRRBR | FQILY | RXRBRB | 17 | 7 | 2 | 3 |
| 323 | Pip-9c2 | RXRRBRR | FQILY | BRXRB | 17 | 7 | 2 | 3 |
| 324 | Pip-9c3 | RXRRBR | FQILY | RRBRB | 16 | 7 | 1 | 3 |
| 325 | Pip-9d | RXRRBR | FQILY | BRBRB | 16 | 6 | 1 | 4 |
| 326 | Pip-9d2 | RXRRBR | FQILY | BRXRB | 16 | 6 | 2 | 3 |
| 327 | Pip-9d3 | RXRRBR | FQILY | XRBRB | 16 | 6 | 2 | 3 |
| 328 | Pip-9d4 | RXRRB | FQILY | RXRBRB | 16 | 6 | 2 | 3 |

R = arginine, X = aminohexanoic acid, B = beta alanine

Figure 41

Urea

| Peptides | vs mdx | vs c57 |
|---|---|---|
| Pip6e | ns | * |
| pip7a | ns | ns |
| Pip7b | ns | ns |
| pip7b2 | ns | ns |
| Pip8b | ns | * |
| Pip8c | ns | ns |
| Pip8c2 | ns | ns |
| Pip9b | ns | ns |
| Pip9b2 | ns | * |
| Pip9c | ns | ns |
| Pip9d | ns | ns |
| Pip9d2 | ns | ns |
| PMO | ns | ns |
| mdx | / | ns |

Creatinine

| Peptides | vs mdx | vs c57 |
|---|---|---|
| Pip6e | ns | ns |
| pip7a | ns | ns |
| Pip7b | ns | ns |
| pip7b2 | ns | ns |
| Pip8b | ns | ns |
| Pip8c | ns | ns |
| Pip8c2 | ns | ns |
| Pip9b | ns | ns |
| Pip9b2 | ns | ns |
| Pip9c | ns | ns |
| Pip9d | ns | ns |
| Pip9d2 | ns | ns |
| PMO | ns | ns |
| mdx | / | ns |

TBIL

| Peptides | vs mdx | vs c57 |
|---|---|---|
| Pip6e | ns | ns |
| pip7a | ns | ns |
| Pip7b | ns | ns |
| pip7b2 | ns | ns |
| Pip8b | ns | ns |
| Pip8c | ns | ns |
| Pip8c2 | ns | ns |
| Pip9b | ns | ns |
| Pip9b2 | ns | ns |
| Pip9c | ns | ns |
| Pip9d | * | ns |
| Pip9d2 | ns | ns |
| PMO | ns | ns |
| mdx | / | ns |

ALP

| Peptides | vs mdx | vs c57 |
|---|---|---|
| Pip6e | * | ns |
| pip7a | * | ns |
| Pip7b | * | ns |
| pip7b2 | ns | ns |
| Pip8b | ns | ns |
| Pip8c | ns | ns |
| Pip8c2 | ns | ns |
| Pip9b | ns | ns |
| Pip9b2 | ns | ns |
| Pip9c | ns | ns |
| Pip9d | ns | ns |
| Pip9d2 | ns | ns |
| PMO | ns | ns |
| mdx | / | * |

ALT

| Peptides | vs mdx | vs c57 |
|---|---|---|
| Pip6e | ns | ns |
| pip7a | ns | ns |
| Pip7b | ns | ns |
| pip7b2 | ns | ns |
| Pip8b | ns | ns |
| Pip8c | ns | ns |
| Pip8c2 | ns | ns |
| Pip9b | ns | ns |
| Pip9b2 | ns | ns |
| Pip9c | ns | ns |
| Pip9d | ns | ns |
| Pip9d2 | ns | ns |
| PMO | ns | * |
| mdx | / | ** |

AST

| Peptides | vs mdx | vs c57 |
|---|---|---|
| Pip6e | ns | ns |
| pip7a | ns | ns |
| Pip7b | ns | ns |
| pip7b2 | ns | ns |
| Pip8b | ns | ns |
| Pip8c | ns | ns |
| Pip8c2 | ns | ns |
| Pip9b | ns | ns |
| Pip9b2 | ns | ns |
| Pip9c | ns | ns |
| Pip9d | ns | ns |
| Pip9d2 | ns | ns |
| PMO | ns | * |
| mdx | / | ** |

LDH

| Peptides | vs mdx | vs c57 |
|---|---|---|
| Pip6e | ns | ns |
| pip7a | ns | ns |
| Pip7b | ns | ns |
| pip7b2 | ns | ns |
| Pip8b | ns | ns |
| Pip8c | ns | ns |
| Pip8c2 | ns | ns |
| Pip9b | ns | ns |
| Pip9b2 | ns | ns |
| Pip9c | ns | ns |
| Pip9d | ns | ns |
| Pip9d2 | ns | ns |
| PMO | ns | ns |
| mdx | / | * |

Figure 47B

CELL-PENETRATING PEPTIDES HAVING A CENTRAL HYDROPHOBIC DOMAIN

FIELD OF THE INVENTION

The present invention relates to peptides particularly, although not exclusively, to cell penetrating peptides and to conjugates of a cell penetrating peptide and a cargo molecule.

BACKGROUND TO THE INVENTION

Oligonucleotides (ONs) that target essential RNA sequences have found numerous recent applications in the modulation of gene expression in cells and as potential therapeutics[1,2]. A mechanistic advantage of steric blocking ONs over RNase H-inducing antisense ONs and RISC-inducing siRNA reagents is greater specificity, since binding of an ON to an incorrect RNA is less likely to trigger an undesired off-target biological effect. Secondly, a much wider range of synthetic ON analogues may be used, since there is no requirement for molecular recognition by a host RNA-cleaving enzyme.

Foremost amongst ON analogues useful as steric blocking agents are those with uncharged backbones, such as peptide nucleic acids (PNA)[3] and phosphorodiamidate morpholino oligonucleotides (PMO)[4]. Both PNA and PMO ONs have been used in vivo for RNA targeting applications towards the development of therapeutics[5]. In cell culture, both PNA and PMO are observed to enter cells only rather poorly and therefore much effort has been expended to develop methods of enhancing cell delivery. Particularly useful has been the attachment of cell penetrating peptides (CPP), such as Penetratin, Tat (48-60), Transportan, and (R-Ahx-R)$_4$ (Ahx=aminohexanoic acid) in the hope that their observed cell translocating power as peptides can be utilized when conjugated to PNA or PMO[6-9].

A valuable assay for assessing the activity of steric blocking ONs is that established by Kole and colleagues which involves splice correction of an aberrant thalassemia β-globin intron by a 18-mer synthetic ON (705 site) in the nucleus of HeLa pLuc705 cells and subsequent up-regulation of reporter firefly luciferase[10]. This assay has a very high dynamic range, such that even very low activity levels can be measured as a positive luminescence read-out. CPP-PNA conjugates targeted to the 705 splice site have been tested in this assay and moderate activity levels have been reported for several different CPPs when the CPP-PNA conjugate is incubated with HeLa pLuc705 cells in the absence of an added transfection agent, whereas PNA alone is inactive[11-13]. In our laboratories, we found that whereas Tat-PNA or (Lys)$_8$-PNA conjugates required co-incubation with 100 μM chloroquine, an endosomolytic agent, in order to see significant activity in the assay[14,15], activity in the μM range for the (R-Ahx-R)$_4$-PNA and (R-Ahx-R)$_4$-PMO constructs could be obtained in the absence of chloroquine[7,16].

We have also reported a CPP in which six Arg residues were added to the N-terminus of the known CPP Penetratin[17,18]. R$_6$-Penetratin (R6Pen) disulfide-conjugated to a PNA complementary to the trans-activation responsive element RNA of HIV-1 showed significant activity in a HeLa cell luciferase reporter assay of inhibition of Tat-dependent trans-activation that required nuclear delivery and binding to TAR RNA in order to inhibit luciferase expression[18].

Duchenne muscular dystrophy (DMD) is an X-linked muscle disorder caused mainly by nonsense or frame-shift mutations in the dystrophin gene, occurring with a frequency of about 1 in 3500 live male births and potential therapies are badly needed[29]. DMD patients suffer from severe, progressive muscle wasting, whereas the milder Becker muscular dystrophy is caused by in-frame deletions resulting in expression of a shortened but partially functional protein. Sequence-specific antisense oligonucleotides (ON) have been shown to induce targeted exon skipping to correct the reading frame of mutated dystrophin mRNA such that shorter dystrophin forms are produced with activity similar to that of Becker muscular dystrophy[30,31]. Studies have been carried out in cell models, in an mdx dystrophic mouse model containing a nonsense mutation in exon 23[31-33], and in a dog model that have shown outstanding promise for the exon skipping approach. Biological activity is achieved as a result of binding of the ON to the dystrophin pre-mRNA in the muscle cell nuclei to cause alteration of splicing patterns by a "steric block" mechanism.

Patients with DMD often suffer from degeneration of cardiac muscle, leading to forms of heart disease such as cardiomyopathy and X-linked dilated cardiomyopathy. Thus, CPPs that allow improved expression of functional or partially functional dystrophin in cardiac muscle are needed.

Antisense oligonucleotides are currently the most promising therapeutic intervention for Duchenne muscular dystrophy. Antisense oligonucleotides modulate dystrophin pre-mRNA splicing, thereby specifically restoring the dystrophin reading frame and generating a truncated but semi-functional dystrophin protein. Challenges in the development of this approach are the relatively poor systemic antisense oligonucleotide delivery and inefficient dystrophin correction in affected non-skeletal muscle tissues, including the heart.

One of the most important factors determining the efficiency of exon skipping is the ON chemistry. The most widely used has been 2'-O-methyl phosphorothioate (2'OMePS). This backbone was initially tested in a Phase I clinical trial targeting exon 51 of dystrophin pre-mRNA in DMD patients involving intramuscular injection[34]. A similar Phase I trial was carried out using a phosphorodiamidate morpholino oligonucleotide (PMO)[35]. Phase II clinical trials involving systemic delivery in DMD patients have recently been completed for both 2'OMePS (Goermans N. M. et al (2011) New England J. Med., 364, 1513-1522) and PMO chemistries (Cirak, S. et al (2011) The Lancet, doi:10.1016/S0140-6736 (11)60756-3). Studies in mice have suggested higher levels of exon skipping and restoration of dystrophin expression using PMO compared to 2'OMePS[35]. PMOs are non-ionic molecules and are considered less likely to form unwanted interactions with the intracellular molecules of target cells.

Yin and Wood have examined another non-ionic analogue called peptide nucleic acids (PNA) by intramuscular injection into mdx mice and found significant induction of exon skipping and dystrophin production[23]. Both PMO and PNA are considered non-toxic ON analogues with high sequence specificity that have significant potential for pharmaceutical development. Exon-skipping PMO has been shown to be well tolerated in mice to 960 mg/kg dosage (Sazani, P. et al (2011) Int, J. Toxocol, 30, 322-333) and to 320 mg/kg in monkeys (Sazani, P. et al (2011) Int. J. Toxicol, 30, 313-321).

Several research groups have been working on the design of CPPs (sometimes called membrane translocating peptides) that when conjugated to non-ionic ONs (such as PNA or PMO) aid their delivery into cells (but not ionic types) and hence boost biological activity of the ON. In the case of PMO, a peptide has been disclosed containing both natural and non-natural amino acids (R-Ahx-R)$_4$-Ahx-B that when conjugated to PMO results in higher levels of steric block activity in a number of cell and in vivo models[36]. This has been investigated in mouse mdx DMD studies[37].

In order to be useful for in vivo applications, it is preferred that CPPs demonstrate effective penetration of the cell and nuclear membranes, particularly when attached to a cargo such as PNA or PMO, in order to enable efficacious splice correction, e.g. $EC_{50}$ about 0.90 µM or less as measured by the splice correction luciferase assay of Kole et al. Furthermore, the CPP should have good serum stability in order to resist degradation prior to cell penetration. For therapeutic applications CPPs should also have low toxicity.

We previously created a series of CPPs which for conjugation to either a PNA cargo having the 20-mer base sequence GGCCAAACCTCGGCTTACCT [SEQ ID NO:309] (called PNADMD) or a PMO cargo having the 25-mer base sequence GGCCAAACCTCGGCTTACCTGAAAT [SEQ ID NO:310] (called PMODMD). Both PNADMD and PMODMD are commonly used as an oligonucleotide analogue suitable for exon skipping in mdx muscle cells (in vitro) and in mdx mice (in vivo). Pip 5e-PMODMD exhibited exon skipping and restoration of dystrophin expression in differentiated mouse H2K muscle cells and in an mdx mouse model of DMD, including induction of dystrophin production in heart muscle. Pip 5e has the sequence: RXRRBRRXRIL-FQYRXRBRXRBC [SEQ ID NO:1] and is disclosed in WO2009/147368 and in Yin et al (Molecular Therapy Vol. 19, No. 7 1295-1303, July 2011). The sequence of the Pip 5e peptide can be broken down into three domains, two Arginine rich domains (RXRRBRRXR [SEQ ID NO: 782] and RXR-BRXRB) [SEQ ID NO: 772] and a central hydrophobic core (ILFQY) [SEQ ID NO: 799]. Pip-5e was found to have good activity in delivery of PMODMD into heart muscle.

Wu et al (Nucleic Acids Research, 2007, Vol. 35, No. 15 5182-5191) reported that CPP-PMOF (F represents a 3'-carboxyfluorescein tag) conjugates in which X or B residues had been inserted into an oligo-R sequence increased splice correction activity and cell uptake and aided serum binding but that the conjugates did not enter cells as efficiently as $R_8$- and $R_9$-conjugates. They also reported that the number of X residues affects both nuclear antisense activity and toxicity of conjugates, with peptides of greater than 5 X residues exhibiting time and concentration dependent toxicity at 60 µM in cell lines. They suggest keeping the number of X residues to less than 5 to reduce toxicity. They also reported that reducing the number of RX or RB repeats in $(RX)_n$ or $(RB)_n$ reduces cell uptake and reduces splice correcting ability (in HeLa cell assay).

Abes et al (Nucleic Acids Research, 2008, 36, 6353-6354) discuss CPP molecules having an $(RXR)_n$-PMO structure and reports that of several spacer (X) molecules tested, a linear $C_4$ (Abu), $C_6$ (Ahx), or $C_8$ (Acy) spacer is most effective.

Saleh et al (Bioconjugate Chem. Vol. 21, No. 10 1902-1911 (2010)) reported that increasing the number of Arginine residues in a linear $(RXR)_n$ arrangement to 12 and 16 for conjugates with PNA increases the splicing correction ability in a HeLa cell assay, but also increased cell toxicity. Chain branching (2 or 4 branches) did not result in improved activity. 2-chain branches and some 4-chain branches were tolerated for 12 and 16 Arginine constructs, but not for 8 Arginine constructs.

Thus, increasing the number of spacer residues, such as X, appears to increase toxicity and reduce efficiency of cell entry compared to oligoR peptides, but can also increase splice correction activity. On the other hand a high number of R residues appears to lead to increased cell entry efficiency but also increased toxicity, which is undesirable. Thus, CPPs are required that provide a balance of good cell entry efficiency and low toxicity. In addition it is desirable for the CPP to show favourable properties in vivo, such as directing high exon skipping and dystrophin production in the mouse model, mdx, in all muscle types, including heart.

SUMMARY OF THE INVENTION

The inventors have now created a new series of CPPs and evaluated their ability to facilitate cell entry of conjugated cargo molecules, and the cellular toxicity of the CPPs.

Unexpectedly, the inventors have identified that the linear N- to C-terminal sequence (i.e. the primary sequence) of the hydrophobic core domain is not essential to cell penetration activity, and that the presence of the core amino acids, rather than their primary sequence, is the important factor. As such, they have realised that the structure-activity relationship is not dependent on a structure provided by a particular linear sequence order of amino acids in the hydrophobic core but is dependent on the presence of certain amino acids in the hydrophobic core. This has enabled the inventors to design a new series of cell penetrating peptides, described herein.

Thus, the inventors have identified a new series of promising cell penetrating peptides. The peptides may act as carrier moieties to facilitate movement of a cargo across cell and nuclear membranes and optionally to deliver cargoes to particular organ types (such as heart). Peptide-cargo conjugates are also provided.

Four novel peptide series have been prepared and have been tested as peptide-PMO cargo conjugates. The peptides and attached cargoes are shown in FIGS. 18 and 41 and are summarised below:

[SEQ ID NOs: 2-10]
Pip-6a, Pip-6b, Pip-6c, Pip-6d, Pip-6e, Pip-6f,

Pip-6g, Pip-6h, Pip-6i;

[SEQ ID NOs: 11-16]
Pip-7a, Pip-7b, Pip-7c, Pip-7d, Pip-7b2, Pip-7c2;

[SEQ ID NOs: 17-20 and 317-319]
Pip-8a, Pip-8b, Pip-8c, Pip-8c2, Pip-8d, Pip-8d2, Pip-8d3;
or

[SEQ ID Nos 320-328]
Pip-9b, Pip-9b2, Pip-9c, Pip-9c2, Pip-9c3, Pip-9d,

Pip-9d2, Pip-9d3, Pip-9d4.

Pip-6a [SEQ ID NO:2], Pip-6b [SEQ ID NO:3], Pip-6c [SEQ ID NO:4], Pip-6d [SEQ ID NO: 5] Pip-6e [SEQ ID NO:6], Pip-6f [SEQ ID NO:7], Pip-6g [SEQ ID NO:8], Pip-6h [SEQ ID NO:9] and Pip-6i [SEQ ID NO:10] conjugated to PMODMD all show high levels of exon skipping in mdx mouse cells in vitro. Pip-6a, Pip-6b and Pip-6f maintained exon skipping and dystophin production in heart muscle in mdx mice (i.e. in vivo), comparable to Pip-5e. Pip-8b, Pip-8c, Pip-9b, Pip-9b2, and Pip-9c have also shown efficient dystrophin restoration in the tibialis anterior (TA), diaphragm, quadriceps and heart, without apparent toxicity.

Accordingly, the cell penetrating peptide component of CPP-PMO conjugates tested and peptides having substantially similar sequence identity and structure are expected to be useful in facilitating cell and nuclear penetration of cargo such as antisense oligonucleotides including PNA, PMO, siRNA, peptides and proteins, as well as small molecules.

Accordingly, the present invention provides peptides that are useful in facilitating the uptake of such cargoes across cell membranes, such as the plasma membrane of a mammalian cell and/or the nuclear membrane of a mammalian cell. The peptides may be referred to as "cell penetrating peptides" and may be conjugated to a cargo to facilitate transport of the cargo across the membrane.

Peptides according to the invention have a sequence that is a chemically contiguous single molecule. The peptide sequence may be comprised of amino acids and optional non-amino acids, e.g. aminohexanoic spacer residues. For example, in some parts of the peptide an aminohexanoic acid spacer may be chemically bonded to the C-terminal end of a first amino acid and to the N-terminal end of a second amino acid, thereby chemically linking the two amino acids. In this specification an amino acid is counted as one "residue" and a spacer molecule or non-natural amino acid is also counted as one "residue".

The peptides may include modified and non-naturally occurring amino acids. Preferably any spacer residues and modified or non-amino acids are linked to adjacent residues by a covalent peptide (amide) bond [—C(=O)NH—].

Each peptide comprises or consists of 3 domains in the following linear arrangement:

N-terminus [Domain 1]-[Domain 2]-[Domain 3] C-terminus

Each domain has common sequence characteristics but the exact sequence of each domain is capable of variation and modification. Thus a range of sequences is possible for each domain. The combination of each possible domain sequence yields a range of peptide sequences which form part of the present invention.

The core peptide sequence is represented by the contiguous amino acid (and optional spacer) sequence of Domains 1-3. An optional linker sequence arranged to allow linkage to the cargo can be present, typically at the C-terminus of Domain 3.

In the following description the standard one letter amino acid code is used. Non-natural amino acids and spacer molecules are referred to using the following one letter code:

X=any of aminohexanoic acid, aminobutyric acid, aminocaprylic acid, β-alanyl, p-aminobenzoyl, isonipecotyl, or 4-aminobutyryl, B=betaAlanine R=Arginine Domain 1 is an arginine rich sequence and may be 4, 5, 6, 7, 8, 9, 10, 11, 12 or more amino acids in length. Preferably Domain 1 has 5, 6, 7, 8, or 9 residues (e.g. X, B or R).

Preferably Domain 1 has two or more cationic amino acids with hydrophobic amino acids or spacer groups separating some of the cationic amino acids. In preferred embodiments the cationic amino acid is Arginine (R). Preferably Domain 1 has at least 2 Arginine residues, and preferably one of 2, 3, 4, 5, or 6 Arginine residues. In some embodiments Domain 1 contains 3, 4, 5, 6 or more Arginine residues.

Domain 1 preferably has a maximum length of less than 15 residues, more preferably less than 13 residues and a minimum length of 4 residues (e.g. X, B or R).

Preferred Domain 1 sequences are chosen from the group of:

```
                         [SEQ ID NO: 782]
RXRRBRRXR

[SEQ ID NO: 783]
RXRRBRRX

[SEQ ID NO: 784]
RXRRBRX

[SEQ ID NO: 785]
RXRBRX
```

-continued

```
                         [SEQ ID NO: 790]
RXRBX

[SEQ ID NO: 786]
RXRRBRXR

[SEQ ID NO: 787]
RXRRBR

[SEQ ID NO: 788]
RXRRB,
or

[SEQ ID NO:789]
RXRRBRR.
```

Domain 2 contains the core amino acid sequence. This comprises a sequence that contains at least 3 of the amino acids $Z_1Z_2$FLI [SEQ ID NO: 798], where $Z_1$ is Y or I and $Z_2$ is Q or R. The amino acids $Z_1Z_2$FLI [SEQ ID NO: 798] may be in any order. It is the inventors finding that the primary sequence of Domain 2 (i.e. order from the N- to C-terminus) is not essential to cell penetration activity. In some particularly preferred embodiments, Domain 2 does not contain an N- to C-terminal contiguous primary sequence of ILFQY [SEQ ID NO: 799], ILFQ [SEQ ID NO: 800] or ILIQ [SEQ ID NO: 801], although it may contain these amino acids in a different N- to C-terminal contiguous primary sequence order.

The Domain 2 sequence may contain 1, 2, 3, 4 or 5 additional amino acids at one or both of the N- or C-terminal ends of the sequence. Preferably there are none, one or two amino acids at the N-terminal end and none, one or two amino acids at the C-terminal end. As such, Domain 2 may be 3, 4, 5, 6, 7, 8, 9 or 10 amino acids in length. Domain 2 is preferably a hydrophobic domain.

Domain 2 preferably has a maximum length of less than 10 residues, more preferably less than 7 residues and a minimum length of 3 residues, more preferably 4 or 5 residues (the respective lengths include spacer groups, e.g. X, and non-natural amino acids). In preferred embodiments Domain 2 has 3, 4, 5, or 6 residues (including spacer groups, e.g. X, and non-natural amino acids). The additional amino acids may be of any type.

Domain 3 is a cationic domain and preferably has a sequence chosen from:

```
                         [SEQ ID NO: 772]
RXRBRXRB

[SEQ ID NO: 773]
XRBRXRB

[SEQ ID NO: 774]
RXRRBRB

[SEQ ID NO: 775]
BRXRB

[SEQ ID NO: 776]
XRRBRB

[SEQ ID NO: 777]
RRBRB

[SEQ ID NO: 778]
XRBRB

[SEQ ID NO: 779]
RBRXRB
```

RXRBRB, [SEQ ID NO: 780]
or

BRBRB [SEQ ID NO: 781]

Preferably Domain 3 has two or more cationic amino acids with hydrophobic amino acids or spacer groups separating some of the cationic amino acids. In preferred embodiments the cationic amino acid is Arginine (R). Preferably Domain 3 has at least 2, 3, or 4 Arginine residues. In some embodiments Domain 3 contains 1, 2, 3, 4, 5, 6 or more Arginine residues.

In some embodiments Domain 3 has a minimum length of 3 amino acids and a maximum length of 15 residues (including spacer groups, e.g. X, and non-natural amino acids). In some embodiments the minimum length, including spacer groups, is 4 or more and the maximum length, including spacer groups, is 12 or less. In some embodiments, Domain 3 has a length of one of 3, 4, 5, 6, 7, 8, 9, 10, 11 or 12 residues.

The total number of Arginine residues in Domains 1, 2 and 3 combined may be 30-60% of the total number of residues and may be one of 30%, 35%, 40%, 45%, 50%, 55% or 60%. In some embodiments the total number of Arginine residues in Domains 1, 2 and 3 combined may be in the range of 30-50% of the total number of residues, or in the range 30%-45%, or 30-40%, or 35-45%.

The use of aminohexanoic acid and betaAlanine in Domains 1 and 3 is advantageous in that it helps minimise the immunogenicity of the peptide and increase the resistance to proteolysis.

A linker may be arranged to allow chemical linkage of the peptide to the cargo. The linker may also act as a spacer to separate the Domain 1-3 part of the peptide from the cargo.

A range of linker sequences are possible, including sequences having a C-terminal Cysteine residue that permits formation of a disulphide, thioether or thiol-maleimide linkage. Other ways of linking the peptide to the cargo include use of a C-terminal aldehyde to form an oxime, use of a click reaction or formation of a morpholino linkage with a basic amino acid on the peptide which may be followed by a spacer sequence before Domain 3 comprising: X or B or XB or BX.

The linker sequence may be 1, 2, 3, 4, 5 or more amino acids and/or residues in length (including spacer groups). The linker sequence may be chosen from the group of: BCys, XCys, Cys, GGCys, BBCys, BXCys, XBCys, X, XX, B, BB, BX or XB. Any B or X may be replaced by another spacer, which, for example, may be chosen from 4-aminobutyryl (Aib) and isonicopecotyl.

The linker sequence may form part of the cargo to which the peptide is to be attached. In some embodiments attachment of the cargo is directly to the C-terminus of the Domain 3 sequence. As such, in some embodiments no linker sequence is required, or it is provided by linkage of the cargo and Domain 3 sequence.

In accordance with the above, peptides according to the invention may be represented as follows:

$Z_4$YQFLI$Z_5$ [SEQ ID NO: 791]

$Z_4$IQFLI,$Z_5$ [SEQ ID NO: 792]

$Z_4$YRFLI$Z_5$ [SEQ ID NO: 793]

$Z_4$YRFRLI$Z_5$ [SEQ ID NO: 794]

$Z_4$FQILY$Z_5$ [SEQ ID NO: 795]

$Z_4$QFLI$Z_5$ [SEQ ID NO: 796]

$Z_4$QFL$Z_5$ [SEQ ID NO: 797]

where $Z_4$ is chosen from one of

RXRRBRRXR [SEQ ID NO: 782]

RXRRBRRX [SEQ ID NO: 783]

RXRRBRX [SEQ ID NO: 784]

RXRBRX [SEQ ID NO: 785]

RXRRBRXR [SEQ ID NO: 786]

RXRRBR [SEQ ID NO: 787]

RXRRB, [SEQ ID NO: 788]
or

RXRRBRR [SEQ ID NO: 789]

and $Z_5$ is chosen from one of

RXRBRXRB [SEQ ID NO: 772]

XRBRXRB [SEQ ID NO: 773]

RXRRBRB [SEQ ID NO: 774]

BRXRB [SEQ ID NO: 775]

XRRBRB [SEQ ID NO: 776]

RRBRB [SEQ ID NO: 777]

XRBRB [SEQ ID NO: 778]

RBRXRB [SEQ ID NO: 779]

RXRBRB, [SEQ ID NO: 780]
or

BRBRB [SEQ ID NO: 781]

where $Z_5$ may optionally comprise a linker at the C-terminal end, which may be one of BCys, XCys, Cys, GGCys, BBCys, BXCys or XBCys, X, XX, B, BB, BX or XB.

Preferred peptides may comprise, or consist of, a sequence chosen from one of SEQ ID NOs 2-308 or 317-761 (FIG. 18, FIGS. 23 to 30 and FIG. 41).

Peptides according to the present invention may be chosen from any one of SEQ ID NOs: 2, 3, 6, or 7.

Excluding the cargo molecule, peptides according to the present invention may have a maximum length of 40 residues, more preferably 30 residues, and still more preferably one of 15, 16, 17, 18, 19, 20, 21, 22, 23, 24, 25, 26, 27, 28, 29, or 30 residues and a minimum length of 10 residues, more preferably one of 10, 11, 12, 13, 14, 15, 16, 17, 18, 19, 20 residues (the maximum and minimum length includes any spacer molecules, e.g. X, and non-natural or modified amino acids).

Peptides according to the present invention may be provided as peptide-cargo conjugates where the peptide further comprises a cargo molecule chemically linked (preferably covalently linked) to the peptide at either the N-terminal or C-terminal end of the peptide, preferably at the C-terminal end. Chemical linkage may be via a disulphide bond, thioether or thiol-maleimide linkage, or via amide linkage through the C-terminal carboxylic acid.

The cargo molecule may be any small molecule, e.g. small molecule drug, peptide, cyclic peptide, protein, pharmaceutical or therapeutic (e.g. molecular weight less than 10,000 Da, preferably less than 5,000 Da or less than 3000 Da, and in some cases less than 1000 Da). The cargo molecule may be a nucleic acid, antisense oligonucleotide (such as PNA, PMO, LNA), or siRNA. Preferred cargo molecules are electrically neutral oligonucleotide analogues such as PNA or PMO.

In one embodiment the cargo is PNA705 (CCTCTTACCT-CAGTTACA [SEQ ID NO:316]). In another embodiment the cargo is PNADMD (SEQ ID NO:309). In another embodiment the cargo is PMODMD (SEQ ID NO:310). The cargo molecule may have at least 80%, preferably at least 90%, sequence identity to one of PNADMD (SEQ ID NO:309) or PMODMD (SEQ ID NO:310). Lysine residues may be added to one or both ends of these PNA or PMO molecules to improve water solubility. Cysteine may be added at the C-terminus or N-terminus to allow for disulphide bond formation or bromoacetylation for thioether conjugation or for thiol-maleimide conjugation.

Peptides according to the present invention may be provided in isolated or purified form, with or without a cargo molecule.

Derivatives of the peptides also form part of the present invention. Peptide derivatives include variants of a given peptide sequence (e.g. one of SEQ ID NOs:2-308) which have substantial amino acid sequence identity (e.g. 90%, 91%, 92%, 93%, 94%, 95%, 96%, 97%, 98%, 99% or 100%) to the full length peptide and preferably have the same or better exon skipping activity or cell viability. Peptide derivatives may have 1, 2 or 3 amino acids or spacer molecules more or less than one of SEQ ID NOs:2-308.

Percentage (%) sequence identity is defined as the percentage of residues (including spacer groups) in a candidate sequence that are identical with residues in the given listed sequence (referred to by the SEQ ID NO.) after aligning the sequences and introducing gaps if necessary, to achieve the maximum sequence identity, and not considering any conservative substitutions as part of the sequence identity. Sequence identity is preferably calculated over the entire length of the respective sequences.

Alignment for purposes of determining percent amino acid sequence identity can be achieved in various ways known to a person of skill in the art, for instance, using publicly available computer software such as ClustalW 1.82. T-coffee or Megalign (DNASTAR) software. When using such software, the default parameters, e.g. for gap penalty and extension penalty, are preferably used. The default parameters of ClustalW 1.82 are: Protein Gap Open Penalty=10.0, Protein Gap Extension Penalty=0.2, Protein matrix=Gonnet, Protein/DNA ENDGAP=−1, Protein/DNA GAPDIST=4.

Peptide derivatives may also comprise conservative amino acid replacements which, for example, may be between amino acids within the following groups:
  (i) glycine, alanine, serine, threonine;
  (ii) glutamic acid and aspartic acid;
  (iii) arginine, histidine and lysine;
  (iv) asparagine and glutamine;
  (v) isoleucine, leucine and valine;
  (vi) phenylalanine, tyrosine and tryptophan.

Peptides according to the present invention preferably show high activity when conjugated to PMODMD in exon skipping in differentiated mouse H2K muscle cells (Yin et al (Molecular Therapy Vol. 19, No. 7 1295-1303, July 2011). Preferably the $EC_{50}$ established in this assay is less than 2 µM. In some embodiments the $EC_{50}$ established in this assay is less than 1 µM, less than 0.9 µM, less than 0.8 µM, less than 0.7 µM, or less than 0.6 µM. Peptides according to the present invention preferably exhibit higher or the same activity (i.e. they have a lower or same $EC_{50}$) in the exon skipping cell assay as one of Pip-5e or $(RXRRBR)_2XB$ [SEQ ID NO: 311].

Peptides according to the present invention preferably exhibit increased serum stability after two hours in serum (e.g. mouse or human serum) compared to R6Pen and preferably equivalent (or optionally better) serum stability compared to Pip-5e or $(RXRRBR)_2XB$ [SEQ ID NO: 311]. Serum stability may be measured by adding an aliquot of Pip-PMO (10 nmoles) to 100% mouse serum (100 µL) and incubating at 37° C. for 120 or 240 min. Each reaction is diluted with 1M guanidinium-HCl solution (300 µL) and ice-cold acetonitrile (600 µL). Samples are mixed and kept at −20° C., and the precipitated serum proteins separated by centrifugation (13000 rpm, 5 min). After centrifugation, the supernatant is collected, lyophilized and the residue dissolved in water for analysis for peptide degradation by MALDI-TOF mass spectrometry and by reversed phase HPLC. HPLC conditions are: Column, C18 reversed-phase (250×4.6 mm); Solvent A, 0.1% TFA, Solvent B, 90% Acetonitrile, 10% solvent A; Gradient, 10%-50% solvent B in 25 minutes.

In the peptides and peptide conjugates of the present invention, amino acids, amino acid spacers and cargo molecules are all preferably chemically linked by covalent bonds.

Peptides and peptide-cargo conjugates according to the present invention may be provided for use in a method of medical treatment. The medical treatment may preferably require delivery of the cargo molecule into a cell and optionally the nucleus of the cell.

Peptides and/or peptide-cargo conjugates are accordingly provided for use in treatment of disease. The use of a peptide and/or a peptide-cargo conjugate in the manufacture of a medicament for the treatment of disease is also provided. A method of treatment of a patient or subject in need of treatment for a disease condition is also provided comprising the step of administering a therapeutically effective amount of a peptide and/or a peptide-cargo conjugate to the patient or subject. Preferably, the cargo component of a peptide-cargo conjugate comprises an active agent (e.g. pharmaceutical agent) capable of treating, preventing or ameliorating the disease.

Diseases to be treated may include any disease where improved penetration of the cell and/or nuclear membrane by a pharmaceutical or therapeutic molecule may lead to an improved therapeutic effect. Diseases to be treated may include disease conditions caused by (in whole or in part) splicing deficiencies, e.g. Duchenne Muscular Dystrophy (DMD), Becker Muscular Dystrophy, and other muscle diseases such as limb-girdle muscular dystrophy (LGMD), facioscapulohumeral muscular dystrophy, congenital muscular dystrophy, oculpharyngeal muscular dystrophy (OMD), distal muscular dystrophy and Emery-Dreifuss muscular dystrophy (EDMD), as well as Menkes Disease[38], β-thalassemia[39], splice correction of tau protein to relieve frontotemporal dementia, parkinsonism and spinal muscular atrophy[39], Hutchinson-Gilford Progeria Syndrome[40], Ataxia-telangiectasia mutated (ATM)[41], spinal muscular atrophy, myotonic dystrophy 1, or cancer. Genes implicated in the pathogenesis of some of these diseases include dystrophin (Duchenne muscular dystrophy and Becker muscular dystrophy), DMPK (DM1 type MD), ZNF9 (DM2 type MD), PABPN1 (OMD), emerin, lamin A or lamin C (EDMD), myotilin (LGMD-1A), lamin A/C (LGMD-1B), caveolin-3 (LGMD-1C), calpain-3 (LGMD-2A), dysferlin (LGMD-2B and Miyoshi myopathy), gamma-sarcoglycan LGMD-2C), alpha-sarcoglycan (LGMD-2D), beta-sarcoglycan (LGMD-2E), delta-sarcoglycan (LGMD-2F and CMD1L), telethonin (LGMD-2G), TRIM32 (LGMD-2H), fukutin-related protein (LGMD-2I), titin (LGMD-2J), and O-mannosyltransferase-1 (LGMD-2K).

In such cases of diseases involving splicing defects the cargo may comprise an oligonucleotide, PNA, PMO or other oligonucleotide types, including LNA, capable of preventing or correcting the splicing defect and/or increasing the production of (e.g. number of) correctly spliced mRNA molecules. The present invention is, of course, not limited to cargo molecules capable of correcting a splicing defect. Cargo molecules may include other oligonucleotide, PNA, PMO or LNA molecules such as oligonucleotide molecules capable of targeting mRNA or microRNA, e.g. siRNA or shRNA for knockdown of gene expression, as well as non-oligonucleotide molecules.

Peptides according to the present invention conjugated to PMODMD have shown superb efficacy in exon skipping in heart muscle leading to production of dystrophin-containing fibres. As heart failure is a major cause of death in patients suffering from DMD, peptides according to the present invention are particularly useful in the treatment of DMD by conjugation to an oligonucleotide (e.g. PNA or PMO) capable of inducing exon skipping leading to production of normal dystrophin in heart tissue, particularly cardiac muscle. This is particularly important in light of the success of the Phase II clinical trials (2'OMe and PMO) which only restore dystrophin in skeletal tissue. There is a concern this may increase the work load on the heart, thereby progressing/accelerating the cardiac disease progression. Peptide-PMODMD conjugates are considered especially useful in the treatment of DMD.

As such, peptides according to the present invention are particularly useful for delivery of cargo molecules to heart tissue, particularly cardiac muscle. Accordingly, peptide-cargo conjugates according to the present invention are provided for use in the treatment of diseases or conditions of the heart or cardiac muscle, or that manifest in the heart or cardiac muscle, such as heart disease, and cardiomyopathy.

Cardiac muscle diseases to be treated may be coronary heart disease, congenital heart disease, ischemic, hypertensive, inflammatory or intrinsic cardiomyopathy. Intrinsic cardiomyopathy includes the following disorders (with associated genes): dilated cardiomyopathy (dystrophin, G4.5, actin, desmin, delta-sarcoglycan, troponin T, beta-myosin heavy chain, alpha-tropomyosin, mitochondrial respiratory chain), dilated cardiomyopathy with conduction disease (lamin A/C), hypertrophic cardiomyopathy (beta-myosin heavy chain, troponin T, troponin I, alpha-tropomyosin, myosin-binding protein C, myosin essential light chain, myosin regulatory light chain, titin), hypertrophic cardiomyopathy with Wolff-Parkinson-White syndrome (AMPK, mitochondrial respiratory chain), and left ventricular noncompaction (G4.5, alpha-dystrobrevin).

The patient or subject to be treated may be any animal or human. The patient or subject may be a non-human mammal, but is more preferably a human patient. The patient or subject may be male or female.

Medicaments and pharmaceutical compositions according to aspects of the present invention may be formulated for administration by a number of routes, including but not limited to, parenteral, intravenous, intra-arterial, intramuscular, intratumoural, intraperitoneal, subcutaneous, oral and nasal. The medicaments and compositions may be formulated in fluid or solid form. Fluid formulations may be formulated for administration by injection to a selected region of the human or animal body.

Administration is preferably in a "therapeutically effective amount", this being sufficient to show benefit to the individual. The actual amount administered, and rate and time-course of administration, will depend on the nature and severity of the disease being treated. Prescription of treatment, e.g. decisions on dosage etc, is within the responsibility of general practitioners and other medical doctors, and typically takes account of the disorder to be treated, the condition of the individual patient, the site of delivery, the method of administration and other factors known to practitioners. Examples of the techniques and protocols mentioned above can be found in Remington's Pharmaceutical Sciences, 20th Edition, 2000, pub. Lippincott, Williams & Wilkins.

The peptides and peptide-cargo conjugates are also provided for use in in vitro methods. For example, the use of a peptide and/or peptide-cargo conjugate in an exon skipping assay or cell viability assay is provided. In addition, the peptides and peptide-cargo conjugates are provided for use in a mouse model of DMD, the mdx mouse, for exon skipping and dystrophin production.

The term "in vitro" is intended to encompass experiments with cells in culture whereas the term "in vivo" is intended to encompass experiments with intact multi-cellular organisms.

A nucleic acid encoding a peptide according to the present invention is also provided. A nucleic acid vector, e.g. plasmid, having a regulatory sequence, e.g. promoter, operably linked to a nucleic acid encoding a peptide according to the present invention is also provided. The vector is preferably capable of expressing the peptide when transfected into a suitable cell, e.g. mammalian, bacterial or fungal cell. The nucleic acids may be provided in isolated or purified form.

In this specification the term "operably linked" may include the situation where a selected nucleotide sequence and regulatory nucleotide sequence are covalently linked in such a way as to place the expression of a nucleotide coding sequence under the influence or control of the regulatory sequence. Thus a regulatory sequence is operably linked to a selected nucleotide sequence if the regulatory sequence is capable of effecting transcription of a nucleotide coding sequence which forms part or all of the selected nucleotide sequence. Where appropriate, the resulting transcript may then be translated into a desired peptide.

In accordance with the above, the following aspects and embodiments of the present invention are provided.

In one aspect of the present invention a peptide is provided having a primary sequence structure comprised of at least three domains, having the arrangement:

N-terminus [Domain 1]-[Domain 2]-[Domain 3] C-terminus wherein
the number of R (Arginine) residues in Domains 1 and 3 combined is at least 5,
the number of X residues in Domains 1 and 3 combined is at least 1,
the number of B residues in Domains 1 and 3 combined is at least 2, wherein X=aminohexanoic acid and B=betaAlanine, and wherein Domain 2 comprises a sequence that contains at least 3 of the amino acids $Z_1Z_2FLI$, where $Z_1$ is Y or I and $Z_2$ is Q or R, and Domain 2 does not contain an N- to C-terminal contiguous primary sequence of ILFQY [SEQ ID NO: 799], ILFQ [SEQ ID NO: 800] or ILIQ [SEQ ID NO: 801].

The total number of residues in Domains 1-3 combined is preferably no more than 50, more preferably no more than 40, and most preferably is between 20 and 30.

In another aspect of the present invention a peptide is provided having a primary sequence structure comprised of at least three domains, having the arrangement:

N-terminus [Domain 1]-[Domain 2]-[Domain 3] C-terminus in which:

(i) Domain 1 comprises a sequence chosen from:

[SEQ ID NO: 762]
RXR$Z_3$ where $Z_3$ is selected from one of:

[SEQ ID NO: 763]
RBRRXR

[SEQ ID NO:764]
RBRRX

[SEQ ID NO: 765]
RBRX

[SEQ ID NO: 766]
RBRXR

[SEQ ID NO: 767]
BRX

[SEQ ID NO: 768]
BX

[SEQ ID NO: 769]
RBR

[SEQ ID NO: 770]
RB,
or

[SEQ ID NO: 771]
RBRR (ii) Domain 2 comprises a sequence that contains at least 3 of the amino acids $Z_1Z_2$FLI, where $Z_1$ is Y or I and $Z_2$ is Q or R, and wherein Domain 2 does not contain an N- to C-terminal contiguous primary sequence of ILFQY [SEQ ID NO: 799], ILFQ [SEQ ID NO: 800] or ILIQ [SEQ ID NO: 801], (iii) Domain 3 comprises a sequence chosen from:

[SEQ ID NO: 772]
RXRBRXRB

[SEQ ID NO: 773]
XRBRXRB

[SEQ ID NO: 774]
RXRRBRB

[SEQ ID NO: 775]
BRXRB

[SEQ ID NO: 776]
XRRBRB

[SEQ ID NO: 777]
RRBRB

[SEQ ID NO: 778]
XRBRB

[SEQ ID NO: 779]
RBRXRB

[SEQ ID NO: 780]
RXRBRB,
or

[SEQ ID NO: 781]
BRBRB wherein X=aminohexanoic acid, B=betaAlanine.

In some embodiments Domain 2 comprises an N- to C-terminal contiguous primary sequence chosen from YQFLI [SEQ ID NO: 802], IQFLI [SEQ ID NO: 803], YRFLI [SEQ ID NO: 804], YRFRLI [SEQ ID NO: 805], FQILY [SEQ ID NO: 806], QFLI [SEQ ID NO: 807], or QFL [SEQ ID NO: 808]. In some embodiments Domain 2 has 4 or 5 amino acids. 7. In some embodiments Domain 2 has 0, 1, 2 or 3 R residues.

In some embodiments Domain 1 comprises, or consists of, a sequence chosen from:

[SEQ ID NO: 782]
RXRRBRRXR

[SEQ ID NO: 783]
RXRRBRRX

[SEQ ID NO: 784]
RXRRBRX

[SEQ ID NO: 785]
RXRBRX

[SEQ ID NO: 786]
RXRRBRXR

[SEQ ID NO: 787]
RXRRBR

[SEQ ID NO: 788]
RXRRB,
or

[SEQ ID NO: 789]
RXRRBRR.

In some embodiments Domain 3 comprises or consists of a sequence chosen from:

RXRBRXRB [SEQ ID NO: 772]

XRBRXRB [SEQ ID NO: 773]

RXRRBRB [SEQ ID NO: 774]

BRXRB [SEQ ID NO: 775]

XRRBRB [SEQ ID NO: 776]

RRBRB [SEQ ID NO: 777]

XRBRB [SEQ ID NO: 778]

RBRXRB [SEQ ID NO: 779]

RXRBRB, [SEQ ID NO: 780]
or

BRBRB. [SEQ ID NO: 781]

In some embodiments the peptide has between 6 and 12 R residues, preferably one of 6, 7, 8, 9, 10, 11 or 12 R residues. Domain 2 may have 1, 2, or 3 R residues. Domain 1 may have 6 R residues or less, e.g. 0, 1, 2, 3, 4, 5, or 6 R residues. Domain 3 may have 4 R residues or less, e.g. 0, 1, 2, 3, or 4 R residues. The R residues may be D-Arginine or L-Arginine, or a mixture of both.

In some preferred embodiments Domains 1 and 3 only contain R, X and B residues, or only have 1, or 2 residues that are not X or B.

As such, Domain 1 may have any combination of (i) 2 to 6 R residues, (ii) 1 to 3 X residues, and (iii) 1 to 2 B residues, and is preferably no more than 10 residues in length and has 0, 1 or 2 residues that are not R, X or B. Domain 3 may have any combination of (a) 2 to 5 R residues, (b) 1 to 3 X residues, and (c) 1 to 3 B residues and is preferably no more than 9 residues in length and has 0, 1 or 2 residues that are not R, X or B.

In some embodiments the peptide has a maximum length of 30 residues, including natural amino acids, X and B residues. As such, in some embodiments Domain 1 may have a length of from 4 to 12 residues, Domain 2 may have a length of from 3 to 9 residues, and Domain 3 may have a length of from 4 to 12 residues, wherein the lengths include natural amino acids, X and B residues.

In some embodiments the peptide comprises, or consists of, a sequence chosen from one of SEQ ID NOs:2-308 or 317-661 (FIGS. 18, 23 to 30 and 41). In some embodiments the peptide comprises, or consists of, a sequence having at least 90% sequence identity to one of SEQ ID NOs: 2-308 or 317-761 (FIGS. 18, 23 to 30 and 41).

In some embodiments the peptide comprises, or consists of, the sequence of Domains 1 to 3 of one of Pip-6a, Pip-6b, Pip-6c, Pip-6d, Pip-6e, Pip-6f, Pip-6g, Pip-6h, Pip-6i [SEQ ID NOs:2-10]; Pip-7a, Pip-7b, Pip-7c, Pip-7d, Pip-7b2, Pip-7c2 [SEQ ID NOs:11-16]; or Pip-8a, Pip-8b, Pip-8c, Pip-8c2, Pip-8d, Pip-8d2, Pip-8d3 [SEQ ID NOs:17-20 and 317-319]; or Pip-9b, Pip-9b2, Pip-9c, Pip-9c2, Pip-9c3, Pip-9d, Pip-9d2, Pip-9d3, Pip-9d4 [SEQ ID Nos 320-328] or a sequence having at least 90% sequence identity to the sequence of Domains 1 to 3 of one of Pip-6a, Pip-6b, Pip-6c, Pip-6d, Pip-6e, Pip-6f, Pip-6g, Pip-6h, Pip-6i [SEQ ID NOs:2-10]; Pip-7a, Pip-7b, Pip-7c, Pip-7d, Pip-7b2, Pip-7c2 [SEQ ID NOs:11-16]; or Pip-8a, Pip-8b, Pip-8c, Pip-8c2, Pip-8d, Pip-8d2, Pip-8d3 [SEQ ID NOs:17-20 and 317-319]; or Pip-9b, Pip-9b2, Pip-9c, Pip-9c2, Pip-9c3, Pip-9d, Pip-9d2, Pip-9d3, Pip-9d4 [SEQ ID Nos 320-328].

In some embodiments, the peptide further comprises a linker sequence at the C-terminus. The linker sequence may be chosen from BCys, XCys, Cys, GGCys, BBCys, BXCys, XBCys, BX, or XB.

In some embodiments, the peptide is chemically conjugated to a cargo molecule. The conjugation may be at the C-terminus of the peptide.

The cargo molecule may be chosen from a nucleic acid, peptide nucleic acid (PNA), phosphorodiamidate morpholino oligonucleotide (PMO), locked nucleic acid (LNA), antisense oligonucleotide, short interfering RNA (siRNA), peptide, cyclic peptide, protein, or drug. The cargo molecule may have a molecular weight less than 5,000 Da. In some embodiments, the cargo molecule is PNADMD [SEQ ID NO:309] or PMODMD [SEQ ID NO:310] or a molecule having at least 90% sequence identity to one of PNADMD [SEQ ID NO:309] or PMODMD [SEQ ID NO:310].

In a further aspect of the present invention a pharmaceutical composition or medicament comprising a peptide according to the present invention is provided. The pharmaceutical composition or medicament may further comprise a pharmaceutically acceptable diluent, adjuvant or carrier.

In another aspect of the present invention a peptide according to the present invention is provided for use in a method of treatment of disease. In another aspect of the present invention the use of a peptide according to the present invention in the manufacture of a medicament for use in the treatment of a disease is provided.

In a further aspect of the present invention a method of treatment of a disease in a patient in need of treatment is provided, the method comprising administering a peptide according to the present invention to the patient.

In a further aspect of the present invention an isolated nucleic acid is provided, the isolated nucleic acid encoding a peptide or peptide-cargo conjugate according to any aspect or embodiment of the present invention. A nucleic acid vector having a regulatory sequence operably linked to such a nucleic acid is also provided.

Peptide Mimetics

The designing of mimetics to a known pharmaceutically or biologically active compound is a known approach to the development of pharmaceuticals and therapeutics based on a "lead" compound. This might be desirable where the active compound is difficult or expensive to synthesise or where it is unsuitable for a particular method of administration, e.g. some peptides may be unsuitable active agents for oral compositions as they tend to be quickly degraded by proteases in the alimentary canal. Mimetic design, synthesis and testing are generally used to avoid randomly screening large numbers of molecules for a target property.

There are several steps commonly taken in the design of a mimetic from a compound having a given target property. Firstly, the particular parts of the compound that are critical and/or important in determining the target property are determined. In the case of a peptide, this can be done by systematically varying the amino acid residues in the peptide, e.g. by substituting each residue in turn. These parts or residues constituting the active region of the compound are known as its "pharmacophore".

Once the pharmacophore has been found, its structure is modelled according to its physical properties, e.g. stereochemistry, bonding, size and/or charge, using data from a range of sources, e.g. spectroscopic techniques, X-ray diffraction data and NMR. Computational analysis, similarity mapping (which models the charge and/or volume of a pharmacophore, rather than the bonding between atoms) and other techniques can be used in this modelling process.

In a variant of this approach, the three-dimensional structure of the ligand and its binding partner are modelled. This can be especially useful where the ligand and/or binding partner change conformation on binding, allowing the model to take account of this in the design of the mimetic.

A template molecule is then selected onto which chemical groups which mimic the pharmacophore can be grafted. The template molecule and the chemical groups grafted on to it can conveniently be selected so that the mimetic is easy to synthesise, is likely to be pharmacologically acceptable, and does not degrade in vivo, while retaining the biological activity of the lead compound. The mimetic or mimetics found by this approach can then be screened to see whether they have the target property, or to what extent they exhibit it. Further optimisation or modification can then be carried out to arrive at one or more final mimetics for in vivo or clinical testing.

With regard to the present invention, a method is provided comprising the step of modifying the peptide structure, optionally followed by testing the modified peptide in a splice correction assay or an exon skipping assay and/or in a cell viability assay. This process of modification of the peptide or peptide mimetic may be repeated a number of times, as desired, until a peptide having the desired splice correction or exon skipping activity and/or cell viability is identified.

The modification steps employed may comprise truncating the peptide or peptide mimetic length (this may involve synthesising a peptide or peptide mimetic of shorter length), substitution of one or more amino acid residues or chemical groups, and/or chemically modifying the peptide or peptide mimetic to increase cell viability, resistance to degradation, transport across cell membranes and/or resistance to clearance from the body and/or to provide activity in exon skipping and dystrophin production in an mdx mouse model of DMD, including in heart muscle.

The invention includes the combination of the aspects and preferred features described except where such a combination is clearly impermissible or expressly avoided.

The section headings used herein are for organizational purposes only and are not to be construed as limiting the subject matter described.

Aspects and embodiments of the present invention will now be illustrated, by way of example, with reference to the accompanying figures. Further aspects and embodiments will be apparent to those skilled in the art. All documents mentioned in this text are incorporated herein by reference.

BRIEF DESCRIPTION OF THE FIGURES

Embodiments and experiments illustrating the principles of the invention will now be discussed with reference to the accompanying figures in which:

FIG. 11. Individual data set showing exon skipping activity in muscle tissue of mdx mice for Pip-5e-PMO. (FIG. 11A) RT-PCR results, (FIG. 11B) Western blot, (FIG. 11C) Plot of quantified Western blot data.

FIG. 17. Individual data set showing exon skipping activity in muscle tissue of mdx mice for Pip-6f-PMO (FIG. 17A) RT-PCR results, (FIG. 17B) Western blot, (FIG. 17C) Plot of quantified Western blot data.

FIG. 18. Table showing amino acid sequence of Pip-5e, Pip-6a, Pip-6b, Pip-6c, Pip-6d, Pip-6e, Pip-6f, Pip-6g, Pip-6h, Pip-6i, Pip-7a, Pip-7b, Pip-7c, Pip-7d, Pip-7b2, Pip7c2, Pip-8a, Pip-8b, Pip8c, Pip-8c2. The total number of residues in Domains 1, 2 and 3 and number of Arg, X and B residues is also indicated.

FIGS. 23A and B. Table showing Domain 1-3 peptide sequences according to the present invention. The sequences all contain the domain 2 sequence YQFLI [SEQ ID NO: 802], with domain 1 sequences selected from RXRRBRRXR [SEQ ID NO: 782], RXRRBRRX [SEQ ID NO: 783], RXRRBRX [SEQ ID NO: 784], RXRRBRXR [SEQ ID NO: 786], RXRBRX [SEQ ID NO: 785], RXBX [SEQ ID NO: 790], RXRRBR [SEQ ID NO: 787], RXRRB [SEQ ID NO: 788], RXRRBRR [SEQ ID NO: 789], and domain 3 sequences selected from RXRBRXRB [SEQ ID NO: 722], XRBRXRB [SEQ ID NO: 773], RXRRBRB [SEQ ID NO: 774], BRXRB [SEQ ID NO: 775], XRRBRB [SEQ ID NO: 776], RRBRB [SEQ ID NO: 777], XRBRB [SEQ ID NO: 778], RBRXRB [SEQ ID NO: 779], RXRBRB [SEQ ID NO: 780], BRBRB [SEQ ID NO: 781].

FIGS. 24A and B. Table showing Domain 1-3 peptide sequences according to the present invention. The sequences all contain the domain 2 sequence IQFLI [SEQ ID NO:803], with domain 1 sequences selected from RXRRBRRXR [SEQ ID NO: 782], RXRRBRRX [SEQ ID NO: 783], RXRRBRX [SEQ ID NO: 784], RXRRBRXR [SEQ ID NO: 786], RXRBRX [SEQ ID NO: 785], RXBX [SEQ ID NO: 790], RXRRBR [SEQ ID NO: 787], RXRRB [SEQ ID NO: 788], RXRRBRR [SEQ ID NO: 789], and domain 3 sequences selected from RXRBRXRB [SEQ ID NO:722], XRBRXRB [SEQ ID NO: 773], RXRRBRB [SEQ ID NO:774], BRXRB [SEQ ID NO: 775], XRRBRB [SEQ ID NO: 776], RRBRB [SEQ ID NO: 777], XRBRB [SEQ ID NO: 778], RBRXRB [SEQ ID NO: 779], RXRBRB [SEQ ID NO: 780], BRBRB [SEQ ID NO: 781].

FIGS. 25A and B. Table showing Domain 1-3 peptide sequences according to the present invention. The sequences all contain the domain 2 sequence QFLI [SEQ ID NO:807], with domain 1 sequences selected from RXRRBRRXR [SEQ ID NO: 782], RXRRBRRX [SEQ ID NO: 783], RXRRBRX [SEQ ID NO: 784], RXRRBRXR [SEQ ID NO: 786], RXRBRX [SEQ ID NO:785], RXBX [SEQ ID NO:790], RXRRBR [SEQ ID NO:787], RXRRB [SEQ ID NO:788], RXRRBRR [SEQ ID NO:789], and domain 3 sequences selected from RXRBRXRB [SEQ ID NO:722], XRBRXRB [SEQ ID NO:773], RXRRBRB [SEQ ID NO:774], BRXRB [SEQ ID NO:775], XRRBRB [SEQ ID NO:776], RRBRB [SEQ ID NO:777], XRBRB [SEQ ID NO:778], RBRXRB [SEQ ID NO:779], RXRBRB [SEQ ID NO:780], BRBRB [SEQ ID NO:781].

FIGS. 26A and B. Table showing Domain 1-3 peptide sequences according to the present invention. The sequences all contain the domain 2 sequence QFL [SEQ ID NO:808], with domain 1 sequences selected from RXRRBRRXR [SEQ ID NO: 782], RXRRBRRX [SEQ ID NO: 783], RXRRBRX [SEQ ID NO: 784], RXRRBRXR [SEQ ID NO: 786], RXRBRX [SEQ ID NO:785], RXBX [SEQ ID NO:790], RXRRBR [SEQ ID NO:787], RXRRB [SEQ ID NO:788], RXRRBRR [SEQ ID NO:789], and domain 3 sequences selected from RXRBRXRB [SEQ ID NO:722], XRBRXRB [SEQ ID NO:773], RXRRBRB [SEQ ID NO:774], BRXRB [SEQ ID NO:775], XRRBRB [SEQ ID NO:776], RRBRB [SEQ ID NO:777], XRBRB [SEQ ID NO:778], RBRXRB [SEQ ID NO:779], RXRBRB [SEQ ID NO:780], BRBRB [SEQ ID NO:781].

FIGS. 27A and B. Table showing Domain 1-3 peptide sequences according to the present invention. The sequences all contain the domain 2 sequence YRFLI [SEQ ID NO:804], with domain 1 sequences selected from RXRRBRRXR [SEQ ID NO: 782], RXRRBRRX [SEQ ID NO: 783], RXRRBRX [SEQ ID NO: 784], RXRRBRXR [SEQ ID NO: 786], RXRBRX [SEQ ID NO:785], RXBX [SEQ ID NO:790], RXRRBR [SEQ ID NO:787], RXRRB [SEQ ID NO:788], RXRRBRR [SEQ ID NO:789], and domain 3 sequences selected from RXRBRXRB [SEQ ID NO:722], XRBRXRB [SEQ ID NO:773], RXRRBRB [SEQ ID NO:774], BRXRB [SEQ ID NO:775], XRRBRB [SEQ ID NO:776], RRBRB [SEQ ID NO:777], XRBRB [SEQ ID NO:778], RBRXRB [SEQ ID NO:779], RXRBRB [SEQ ID NO:780], BRBRB [SEQ ID NO:781].

FIGS. 28A and B. Table showing Domain 1-3 peptide sequences according to the present invention. The sequences all contain the domain 2 sequence FQILY [SEQ ID NO:806], with domain 1 sequences selected from RXRRBRRXR [SEQ ID NO: 782], RXRRBRRX [SEQ ID NO: 783], RXRRBRX [SEQ ID NO: 784], RXRRBRXR [SEQ ID NO: 786], RXRBRX [SEQ ID NO:785], RXBX [SEQ ID NO:790], RXRRBR [SEQ ID NO:787], RXRRB [SEQ ID NO:788], RXRRBRR [SEQ ID NO:789], and domain 3 sequences selected from RXRBRXRB [SEQ ID NO:722], XRBRXRB [SEQ ID NO:773], RXRRBRB [SEQ ID NO:774], BRXRB [SEQ ID NO:775], XRRBRB [SEQ ID NO:776], RRBRB [SEQ ID NO:777], XRBRB [SEQ ID NO:778], RBRXRB [SEQ ID NO:779], RXRBRB [SEQ ID NO:780], BRBRB [SEQ ID NO:781].

FIGS. 29A and B. Table showing Domain 1-3 peptide sequences according to the present invention. The sequences all contain the domain 2 sequence YRFRLI [SEQ ID NO: 805], with domain 1 sequences selected from RXRRBRRXR [SEQ ID NO: 782], RXRRBRRX [SEQ ID NO: 783], RXRRBRX [SEQ ID NO: 784], RXRRBRXR [SEQ ID NO: 786], RXRBRX [SEQ ID NO:785], RXBX [SEQ ID NO:790], RXRRBR [SEQ ID NO:787], RXRRB [SEQ ID NO:788], RXRRBRR [SEQ ID NO:789], and domain 3 sequences selected from RXRBRXRB [SEQ ID NO:722], XRBRXRB [SEQ ID NO:773], RXRRBRB [SEQ ID NO:774], BRXRB [SEQ ID NO:775], XRRBRB [SEQ ID NO:776], RRBRB [SEQ ID NO:777], XRBRB [SEQ ID NO:778], RBRXRB [SEQ ID NO:779], RXRBRB [SEQ ID NO:780], BRBRB [SEQ ID NO:781].

FIGS. 30A and B. Table showing Domain 1-3 peptide sequences according to the present invention. The sequences all contain the domain 2 sequence ILFRY [SEQ ID NO:811], with domain 1 sequences selected from RXRRBRRXR [SEQ ID NO: 782], RXRRBRRX [SEQ ID NO: 783], RXRRBRX [SEQ ID NO: 784], RXRRBRXR [SEQ ID NO: 786], RXRBRX [SEQ ID NO:785], RXBX [SEQ ID NO:790], RXRRBR [SEQ ID NO:787], RXRRB [SEQ ID NO:788], RXRRBRR [SEQ ID NO:789], and domain 3 sequences selected from RXRBRXRB [SEQ ID NO:722], XRBRXRB [SEQ ID NO:773], RXRRBRB [SEQ ID NO:774], BRXRB [SEQ ID NO:775], XRRBRB [SEQ ID NO:776], RRBRB [SEQ ID NO:777], XRBRB [SEQ ID NO:778], RBRXRB [SEQ ID NO:779], RXRBRB [SEQ ID NO:780], BRBRB [SEQ ID NO:781].

FIG. 31. Statistical tables for quantitative immunohistochemical staining mean values for C57BL10 control, mdx untreated and Pip6-PMO treated mdx mice, following a single 12.5 mg/kg, IV injection. Statistical significance tables for immunohistochemical staining of quadriceps, diaphragm, and heart muscles for Pip6a-f treated mdx mice relative to untreated mdx mice. Statistical significance was determined using a repeated measures, multilevel statistical model (**=$p<0.0001$, *=$p<0.001$, **=$p<0.01$, *=$p<0.05$, N/S=not significant).

FIG. 32. Statistical tables for quantitative immunohistochemical staining mean values for C57BL10 control, mdx untreated and Pip6-PMO treated mdx mice, following a single 12.5 mg/kg, IV injection. Statistical significance tables for immunohistochemical staining of quadriceps, diaphragm, and heart muscles for Pip6a-f treated mdx mice relative to Pip5e treated mice. Statistical significance was determined using a repeated measures, multilevel statistical model (**=$p<0.0001$, *=$p<0.001$, **=$p<0.01$, *=$p<0.05$, N/S=not significant).

FIG. 38. qRT-PCR mean values table and quantification of western blots for C57BL10 control, mdx untreated and Pip6-PMO treated mdx mice, following a single 12.5 mg/kg, IV injection.

FIG. 39. Statistical tables for quantitative immunohistochemical staining, qRT-PCR mean values table and quantification of western blots for C57BL10 control, mdx untreated and Pip6e-PMO derivative (Pip6g and Pip6h) treated mdx mice, following a single 12.5 mg/kg, IV injection. Statistical significance tables for immunohistochemical staining of quadriceps, diaphragm, and heart muscles for Pip6g and Pip6h treated mdx mice relative to untreated mdx mice (FIG. 39a) or Pip6e treated mice (FIG. 39b). Statistical significance was determined using a repeated measures, multi-level statistical model (**=p<0.0001, *=p<0.001, **=p<0.01, *=p<0.05, N/S=not significant). (FIG. 39c) Mean q-RT-PCR percentage values for Pip6g and Pip6h-PMO treated mdx mice.

FIG. 40. Toxicity assays assessed in blood samples of C57BL10 control, mdx untreated, Pip6-PMO and Pip5e-PMO treated mdx mice, following a single 12.5 mg/kg, IV injection.

FIG. 41. Table showing amino acid sequence of Pip-8d, Pip-8d2, Pip-8d3, Pip-9b, Pip-9b2, Pip-9c, Pip-9c2, Pip-9c3, Pip-9d, Pip-9d2, Pip-9d3, Pip-9d4. The total number of residues in Domains 1, 2 and 3 and number of Arg, X and B residues is also indicated.

DETAILED DESCRIPTION OF THE INVENTION

Figure 1:
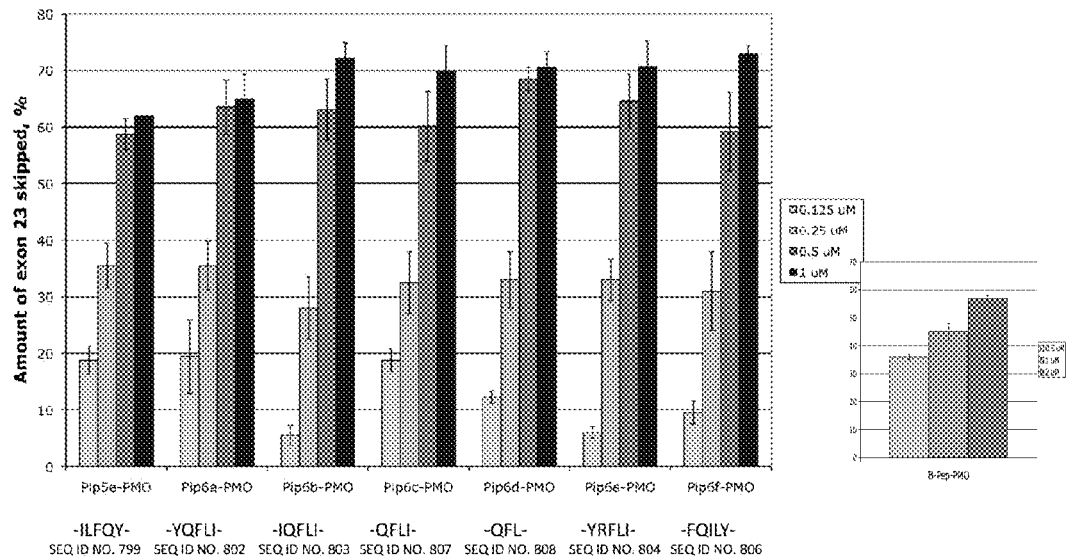
FIG. 1. Graph showing exon skipping activity of PMO-Peptides (Pip-5e, Pip-6a, Pip-6b, Pip-6c, Pip-6d, Pip-6e, Pip-6f) in differentiated mouse H2K mdx muscle myotubes. H2K mdx myotubes were incubated with peptide-PMO conjugates at concentrations ranging between 0.125 μM to 1 μM without the use of transfection reagent. The products of nested RT-PCR were examined by electrophoresis on a 2% agarose gel. Exon skipping activity is presented as the percentage of Δ23 skipping as calculated by densitometry.

The details of one or more embodiments of the invention are set forth in the accompanying description below including specific details of the best mode contemplated by the inventors for carrying out the invention, by way of example. It will be apparent to one skilled in the art that the present invention may be practiced without limitation to these specific details.

The inventors have designed a further series of cell penetrating peptides designed for conjugation to PMO to investigate the role of the central hydrophobic core sequence in obtaining high exon skipping and dystrophin production in the heart muscles in a mdx mouse model of Duchenne muscular dystrophy (DMD) whilst maintaining the high activity across all muscles types compared to already disclosed Pip5e-PMO. In particular the inventors have sought to design a CPP that a) exhibits enhanced delivery of PMO cargo in heart muscle, and b) has low toxicity.

In view of this, the inventors have designed a series of peptides that differ in two main aspects from the previously disclosed Pip-2 to Pip-5 series.
1) The sequence of the domain 2 hydrophobic core amino acids has been inverted, or scrambled.
2) The number of Arginine residues has been systematically varied to determine effect on cargo delivery and cellular toxicity.

We describe a series of peptides designed for conjugation to PMO to investigate the role of the central hydrophobic core in obtaining high exon skipping and dystrophin production in the heart muscles in an mdx mouse model of Duchenne muscular dystrophy (DMD) whilst maintaining the high activity across all muscles types compared to the already disclosed Pip5e-PMO.

Example 1

We have previously reported impressive heart activity including high splicing efficiency and dystrophin restoration following a single administration of an arginine-rich cell-penetrating peptide conjugated to a phosphorodiamidate morpholino oligonucleotide: Pip5e-PMO. However, the mechanisms underlying this activity are poorly understood.

Here, we report the results of studies involving single dose administration (12.5 mg/kg) of a series of derivatives of Pip5e-PMO, consecutively assigned as Pip6-PMOs, containing mutations to the hydrophobic core region of the Pip5e peptide, where this central core region amino acid sequence is reversed, scrambled or partially deleted. These changes affect the levels of exon skipping and dystrophin restoration in multiple muscle groups, including the heart, following a single, low dose intravenous injection of the corresponding Pip6-PMO conjugates. The results show that a core length of 5 amino acids (5-aa) appears to be essential for heart dystrophin production, since reductions in core length reduced cardiac activity. Unexpectedly, an arginine residue was (partially) tolerated in one position of the hydrophobic core, but two arginine residues were not tolerated, nor an arginine in a different position. Surprisingly, skeletal dystrophin production was also reduced in these two latter cases. Our data indicate that the hydrophobic core of the Pip sequences is critical for PMO delivery to the heart and that specific modifications to this region can enhance activity further. The results have implications for therapeutic PMO development for DMD.

Results

Development of the Pip6 CPP Series

Our previous lead Pip series CPP, Pip5e [Yin, H., et al., *Pip5 transduction peptides direct high efficiency oligonucleotide-mediated dystrophin exon skipping in heart and phenotypic correction in mdx mice*. Mol Ther, 2011. 19(7): p. 1295-303], contains two arginine-rich flanking regions and a central hydrophobic core. To further probe the composition requirements of the hydrophobic core for maintenance of good heart dystrophin production, we synthesized a range of Pip5e derivative peptides (Pip6 a-f) where mutations were made only to the hydrophobic core region, for example scrambled and partially deleted core region peptides.

All peptides contained the same number of arginine residues (10) in the flanking sequences as in Pip5e, with the exception of Pip6e. These peptides were conjugated to a 25-mer PMO complementary to dystrophin exon 23 [Yin, H., et al., *Cell-penetrating peptide-conjugated antisense oligonucleotides restore systemic muscle and cardiac dystrophin expression and function*. Hum Mol Genet, 2008. 17(24): p. 3909-18; Yin, H., et al., *A fusion peptide directs enhanced systemic dystrophin exon skipping and functional restoration in dystrophin-deficient mdx mice*. Hum Mol Genet, 2009. 18(22): p. 4405-14.], previously validated for exon skipping in mdx mice. In contrast to the method of conjugation to the 5' end of PMO that we utilised previously [Yin et al supra], Pip6-PMO conjugates were prepared by conjugation of the 3' end of the PMO to the C-terminal carboxylic acid moiety of the Pip peptide. We reported that there was no significant difference between the in vivo dystrophin production or exon skipping activity for Pip5e-PMO conjugated to the 3' end of the PMO or to the 5' end and therefore chose to utilise 3' end conjugation for these experiments [Saleh A F, A.A.A., Yin H, Betts C, Hammond S, Wood M J A and Gait M J, *Enhancement of exon skipping and dystrophin production by 3'-peptide conjugates of morpholino (PMO) oligonucleotides in a mdx mouse model of Duchenne muscular dystrophy in Collection Symposium Series, Chemistry of Nucleic Acid Components*. 2011, Institute of Organic Chemistry and Biochemistry, Academy of Sciences of the Czech Republic: Prague. p. 292-296].

Synthesis of Pip Conjugates of Alternative Cargo PMO Oligonucleotide

PMO 25-mer M23D(+7-18) (5'-GGCCAAACCTCGGCT-TACCTGAAAT-3' [SEQ ID NO:310]) (PMODMD) is commonly used as an oligonucleotide analogue suitable for exon skipping in mdx mice[37, 42, 43,44]. In many of these examples, B peptide (sequence RXRRBRRXRRBRXB [SEQ ID NO:311]) was conjugated to PMODMD and shown to significantly enhance exon skipping and dystrophin production by intramuscular or intravenous delivery in mdx mice compared to naked PMODMD. The B-peptide (which differs from $(RXR)_4XB$ by only two replacements of X by B units) is a leading candidate peptide for clinical trial development in conjugation with a PMO for DMD treatment[43].

The peptides were synthesized by standard Fmoc-based solid phase synthesis on a Liberty microwave peptide synthesizer (CEM). Peptides were cleaved from the resin by treatment with trifluoroacetic acid (TFA, 94%) in the presence of triisopropylsilane (1%), 1,2-ethanedithiol (2.5%) and water (2.5%), purified by reversed phase HPLC and analysed by MALDI-TOF mass spectrometry on an Applied Biosystems Voyager DE-PRO using a matrix of β-cyano-4-hydroxycinnamic acid (10 mg/ml) dissolved in acetonitrile/3% aqueous TFA (1:1, v/v).

The amino acid sequences of peptides Pip-6a to Pip-6i, Pip-7a to Pip-7c2 and Pip8a to Pip-8c2 are shown in FIG. 18.

Pip-6a to Pip-6i, Pip-7a to Pip-7c2 and Pip8a to Pip-8c2 and control B peptide were synthesized as conjugates of PMODMD. Peptides were conjugated via an amide coupling reaction of a C-terminal carboxylic acid to the 3'-end of a 25-mer PMO (see Yin et al. Molecular Therapy Vol. 19, No. 7 1295-1303, July 2011). Briefly, 3'-amide linkage was carried out as follows: PMO (100 nmole) in DMSO was coupled with a 2-fold excess of peptide using TBTU:HOAt:DIEA (2.5:1.8: 1.7 molar excess over peptide) in NMP at 37° C. for 2h. The conjugate was purified by cation exchange HPLC (Source 15S, GE Healthcare) and desalted on a HLB column (Waters).

Cell Culture Exon Skipping Assays in Differentiated H2K mdx Muscle Myotubes

The exon skipping potential of Pip6-PMO conjugates was evaluated in differentiated mouse H2K mdx myotubes in the absence of any transfection agent (FIG. 1) at concentrations ranging from 0.125 μM to 1 μM. This showed that exon skipping activity in cultured muscle cells was very similar for all these constructs, including Pip5e-PMO. These results differ from the previous Pip5 series [Yin et al supra], where the flanking arginine-rich sequences mostly contained a fixed number of arginine residues (10) but where spacings were varied through alternative placement of aminohexanoyl (aminohexanoic acid) and β-alanine units. This resulted in small variations in exon skipping activity that correlated well with in vivo activity. In the case of Pip6 sequences, the flanking arginine-rich sequences are identical (with the exception of Pip6e, which is identical except for one arginine immediately preceding the core which is displaced into the second position of the core). The results demonstrate that cellular exon skipping activity does not depend on the sequence or length of the hydrophobic core. Note that we have previously shown that major changes in in vitro exon skipping activities are correlated instead with the total numbers of arginine residues [Saleh, A. F., et al., *Synthesis and splice-redirecting activity of branched, arginine-rich peptide dendrimer conjugates of peptide nucleic acid oligonucleotides*. Bioconjug Chem, 2010. 21(10): p. 1902-11.].

H2K mdx myotubes are derived from H2K mdx myoblasts obtained from the EDL muscle of a male H2K mdx f2 mouse. The cells are dystrophin deficient and conditionally immortal due to thermolabile simian virus 40 large tumor antigen (tsA58) expression. The myoblasts proliferate at 33° C. (10% $CO_2$) in rich culture and differentiate into myotubes at 37° C. in media with horse serum.

H2K mdx myotubes were prepared and incubated with peptide-PNA and peptide-PMO conjugates in the absence of any transfection agent by the methods described previously (Wang, Q, Yin, H, et aL (2010) In vitro evaluation of novel antisense oligonucleotides is predictive of in vivo exon skipping activity for Duchenne muscular dystrophy) but with minor variations.

Myotubes were obtained from confluent H2K mdx cells seeded in gelatine coated 24-well plates following 2 days of serum deprivation (DMEM with 5% horse serum). The conjugates were incubated with myotubes for 4 h in 0.5 mL OptiMEM and then replaced by 1 mL of DMEM/5% horse serum media for further incubation. After 20 h myotubes were washed twice with PBS and total RNA was extracted with 0.5 mL of TRI Reagent (Sigma, UK). RNA preparations were treated with RNAse free DNAse (2U) and Proteinase K (20 mg) prior to RT-PCR analysis. RT-PCR was carried out in 25 µL with 1 µg RNA template using SuperScript III One-Step RTPCR System with Platinum Taq DNA polymerase (Invitrogen) primed by forward primer 5'CAG AAT TCT GCC AAT TGC TGAG3' [SEQ ID NO:312] and reverse primer 5'TTC TTC AGC TTG TGT CAT CC3' [SEQ ID NO:313]. The initial cDNA synthesis was performed at 55° C. for 30 min followed by 30 cycles of 95° C. for 30 sec, 55° C. for 1 min and 68° C. for 80 sec. RT PCR product (1 mL) was then used as the template for secondary PCR performed in 25 µL with 0.5 U Super TAQ polymerase (HT Biotechnologies) and primed by forward primer 5'CCC AGT CTA CCA CCC TAT CAG AGC3' [SEQ ID NO:314] and reverse primer 5'CCT GCC TTT AAG GCT TCC TT3' [SEQ ID NO:315]. The cycling conditions were 95° C. for 1 min, 57° C. for 1 min and 72° C. for 80 sec for 25 cycles. Products were examined by 2% agarose gel and after scanning using Gene Tools Analysis Software (SynGene) the relative amount of exon 23 skipping was expressed as a percentage at a given concentration of conjugates averaged over duplicates of three experiments.

The results (FIG. 1) showed that all of the Pip-6a-PMO, Pip-6b-PMO, Pip-6c-PMO, Pip-6d-PMO, Pip-6e-PMO and Pip-6f-PMO conjugates gave high exon skipping activity in mdx muscle cells.

Pip-6g-PMO, Pip-6h-PMO, Pip-6i-PMO, Pip-7a-PMO, Pip-7b-PMO, Pip-7b2-PMO, Pip-7c2, Pip-8a-PMO, Pip-8b, and Pip-8c conjugates also gave high exon skipping activity in mdx muscle cells and Pip 7c and Pip7d gave moderate exon skipping (FIGS. 2-5).

In Vivo Assays of Pip6-PMO Conjugates in the Mdx Mouse

Given the potency of Pip5e-PMO in heart tissue, the aim of altering the sequence of the hydrophobic core (whilst maintaining the 5-aa length) was to identify peptides that might be more efficient at lower doses. These modifications included inversion of the hydrophobic region (Pip6a), substitution of tyrosine by isoleucine (Pip6b), substitution of glutamine in the Pip6a sequence by displacement of the arginine immediately flanking the core in the first arginine-rich flanking region (Pip6e), and a scrambled hydrophobic core sequence (Pip6f). All Pip6 peptide-PMO conjugates were administered to mdx mice as single 12.5 mg/kg intravenous injections via the tail vein and tissues were harvested 2 weeks later and assessed for activity at both RNA and protein levels.

Figure 34A:
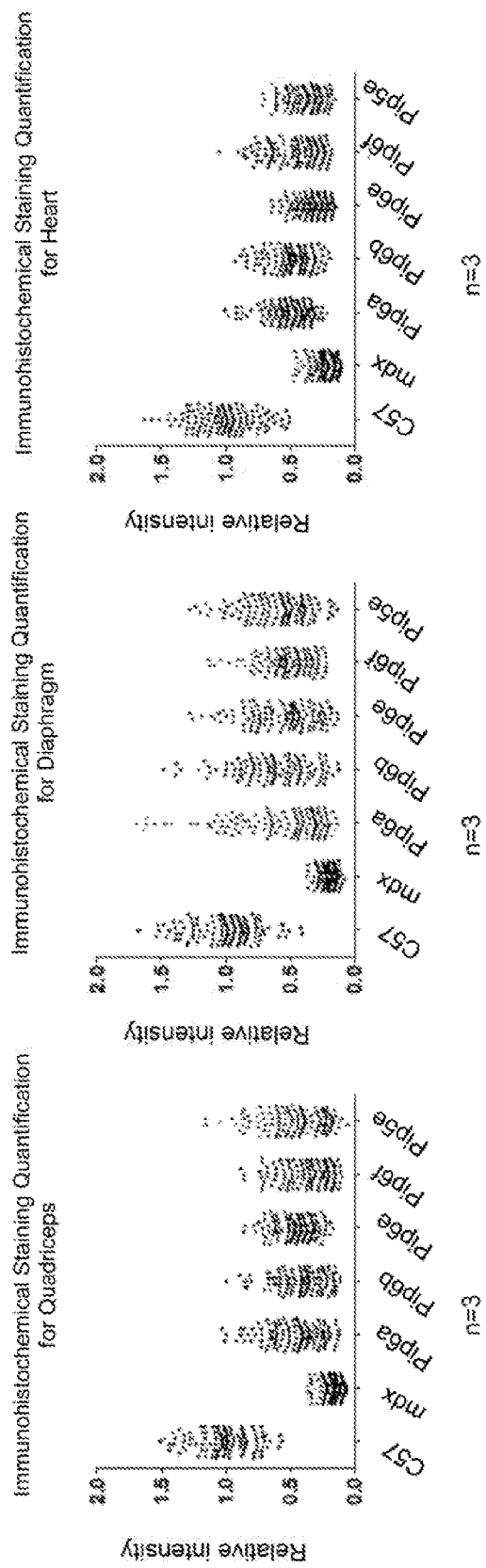
(FIG. 34a) Quantification of dystrophin immunohistochemical staining relative to control laminin counter-stain in quadriceps, diaphragm and heart muscles of C57BL10, mdx untreated and mdx treated mice. Relative intensity values for each region of interest (120 regions) are plotted and the model estimate average calculated (presented in FIG. 34b) from the repeated measures, multi-level statistical model. For statistical significance tables see FIGS. 31 & 32. Percentage recovery score is represented below.
Figure 34B:
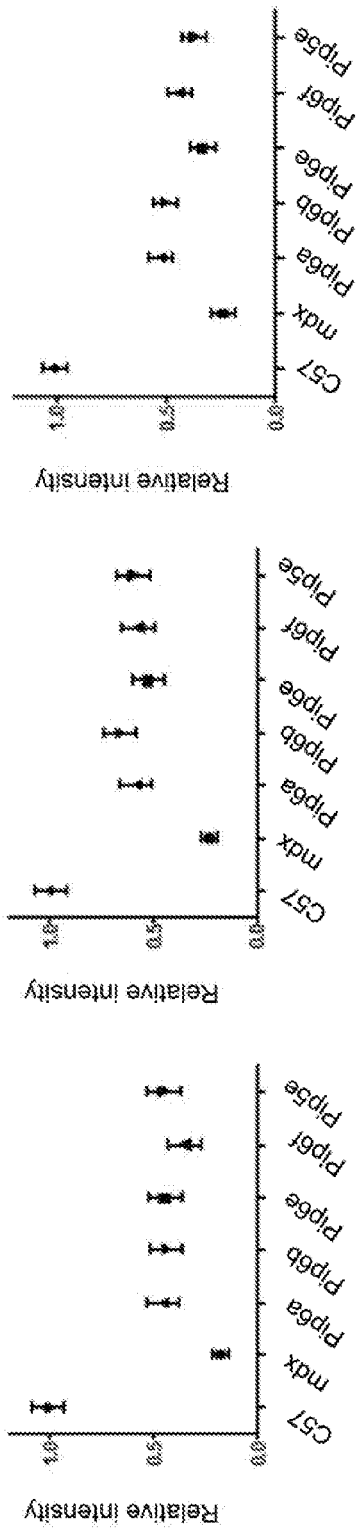
FIG. 34. Dystrophin splicing and protein restoration in C57BL10 control, mdx untreated, the 5-aa hydrophobic core Pip6-PMO treated and Pip5e-PMO treated mice following a single 12.5 mg/kg, IV injection.
(FIG. 34c) Percentage Δ23 exon skipping as determined by quantitative real time (q-RT)-PCR in quadriceps, diaphragm and heart muscles.
(FIG. 34d) Representative real time (RT)-PCR images demonstrating exon skipping (skipped) in TA, quadriceps, gastrocnemius, diaphragm, heart and abdomen muscles. The top band indicates full length (FL) or un-skipped transcript.
(FIG. 34e) Representative western blot images for each treatment. Ten micrograms of total protein was loaded (TA, quadriceps, gastrocnemius, diaphragm, heart and abdomen muscles) relative to 50% (5 μg protein) and 10% (1 μg) C57BL10 controls, and normalised to α-actinin loading control (for quantification see FIG. 38a).

Immunohistochemical staining of dystrophin expression for all 5-aa core Pip6-PMOs revealed high levels of dystrophin production in skeletal muscles including the TA, diaphragm, and the heart. Immunohistochemical staining quantification (FIGS. 34a, b) was performed as previously described [Malerba, A., et al., *Chronic systemic therapy with low-dose morpholino oligomers ameliorates the pathology and normalizes locomotor behavior in mdx mice*. Mol Ther, 2011. 19(2): p. 345-54; Arechavala-Gomeza, V., et al., *Immunohistological intensity measurements as a tool to assess sarcolemma-associated protein expression*. Neuropathol Appl Neurobiol, 2010. 36(4): p. 265-74.] and was achieved by taking 4 representative frames of the dystrophin staining and correlating this with laminin staining for each section (n=3) of the quadriceps, diaphragm and heart for each peptide-PMO treatment. Untreated mdx and treated mdx mice were normalised to C57BL10 mice. This method allows comparison of the staining intensity of dystrophin at the sarcolemma relative to laminin for each treatment group. Intensity ratios are normalised to C57BL10 samples and each region of interest at the sarcolemma (120 regions for each treatment group) is plotted on a scatter graph. The relative intensity values obtained for all four of the 5-aa core Pip6-PMO conjugates were significantly different to those of untreated mdx mice for the quadriceps and diaphragm (FIG. 34b and FIG. 31). There were very similar dystrophin restoration levels in the quadriceps (percent recovery score—% RS—range between 21.10-33.44%; FIG. 34b) and in the diaphragm for all treatments, with the exception of Pip6b which had a higher recovery score in the diaphragm (% RS range between 38.87-48.43%, Pip6b 56.72%; FIG. 34b). All 5-aa core Pip6-PMO-treated mice exhibited high dystrophin intensity values in the heart with the exception of Pip6e (other Pip6-PMOs were statistically significant compared to mdx=p<0.0001; FIG. 31). Pip6a- and Pip6b-PMO conjugates displayed the highest recovery scores, as observed in FIG. 34b, (% RS 37.66% and 34.22% respectively) closely followed by Pip6f-PMO (% RS 26.24%) and then Pip5e-PMO (% RS 17.32%). When directly compared to Pip5e-PMO treatment, only Pip6a-PMO was significantly better in the heart (FIG. 32). These 5-aa core Pip6-PMOs were also shown to restore other dystrophin complex proteins, namely nNOS, α-sarcoglycan and β-sarcoglycan as illustrated by immunohistochemical staining in the TA muscle.

Figure 34C:
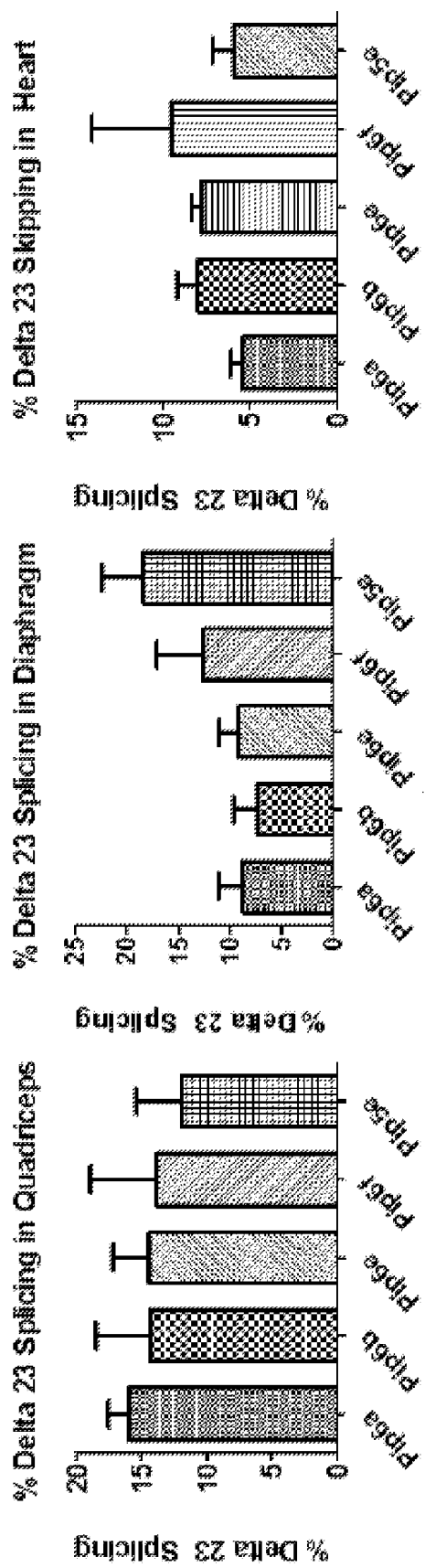
Figures 34D, 34E:
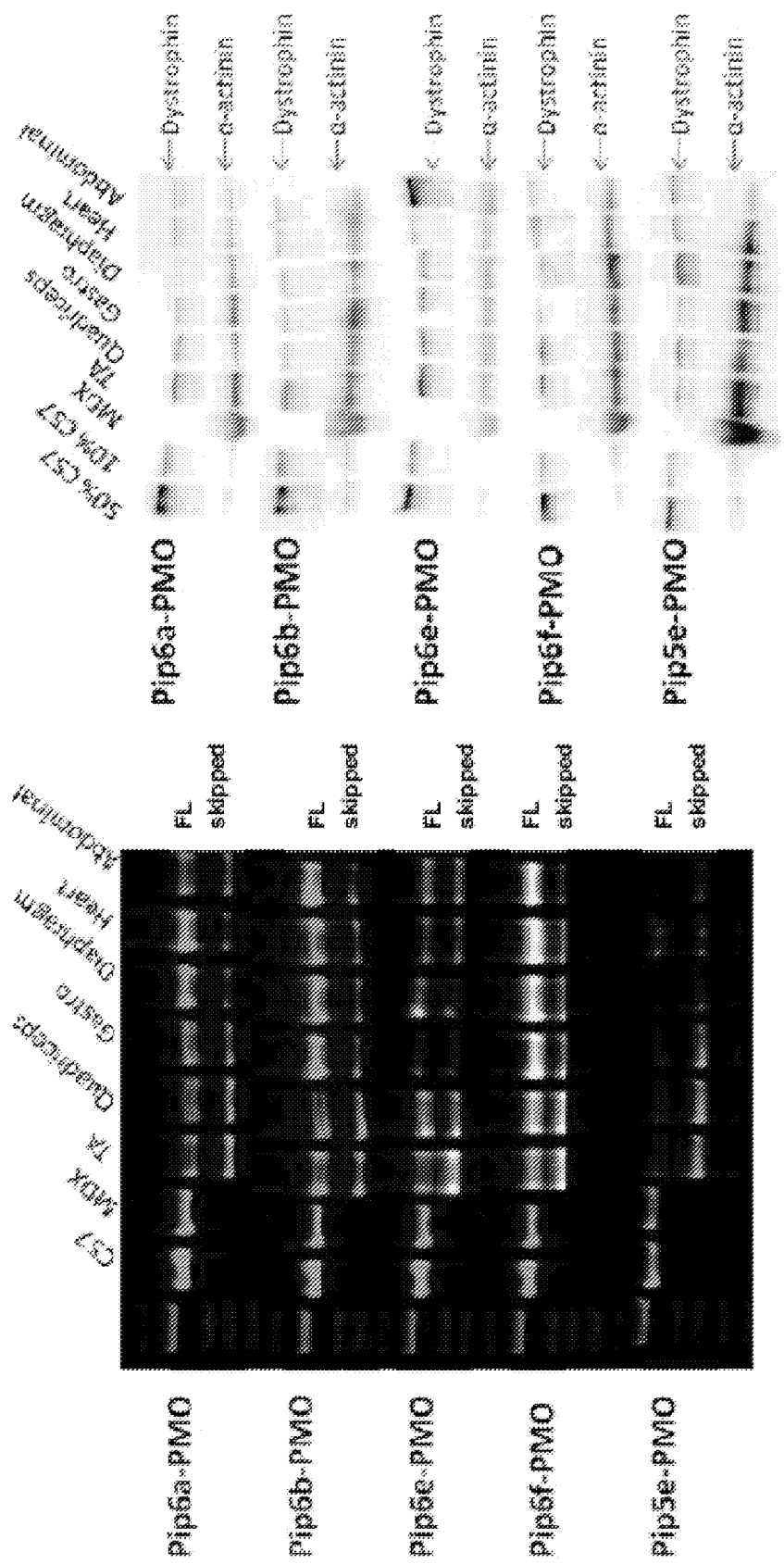

The PCR and western blot analyses exhibited similar results to the immunostaining. The RTPCR representative images (FIG. 34d) illustrate high exon skipping efficiency in all tissues analysed. This is better shown by Real Time PCR (qRT-PCR) results for the quadriceps, diaphragm and heart (FIG. 34c). The delta 23 transcript is normalised against 'total dystrophin' for each muscle group (n=3). Quantification of this data revealed similar levels of Δ23 skipping in the quadriceps of all 5-aa Pip6-PMO treated mice. The data trends suggest that Pip6f- and Pip5e-PMO show the highest exon skipping in the diaphragm, and Pip6f-PMO the highest in heart (for splicing mean values see FIG. 38a). Western blots (FIG. 34e) were performed on the tissues of each mouse and were quantified against a 50% and 10% C57BL10 control. These results were averaged and are presented in FIG. 38b. Pip6a-, Pip6b-, Pip6e- and Pip6f-PMO conjugates exhibited the highest dystrophin protein restoration in the TA and quadriceps muscles. The levels of dystrophin restoration in the diaphragm were uniform across all of these treatments, whereas in the case of the heart, Pip6b- and Pip6f-PMO conjugates showed the highest dystrophin restoration.

Protein restoration as measured by immunohistochemical staining is consistently higher than protein restoration calculated by western blot analysis. These differences may be attributed to the differing 'housing proteins' used i.e. dystrophin restoration quantified by immunohistochemical staining is normalised against laminin, whereas western blot analysis uses alpha-actinin for normalisation. Quantification of western blots has only recently been reported for dystrophin and currently uses chemiluminescence methods. It may therefore be judicious to give greater weight to the trends in dystrophin protein levels revealed by western blot rather than to the absolute values. Therefore, considering the results overall, mdx mice treated with each of the four 5-aa core Pip6-PMOs (Pip6a-, Pip6b-, Pip6e- and Pip6f-PMO) appear to demonstrate improved dystrophin production and exon skipping in TA, quadriceps and heart muscles compared with the previous lead candidate, Pip5e-PMO.

Figure 40A:
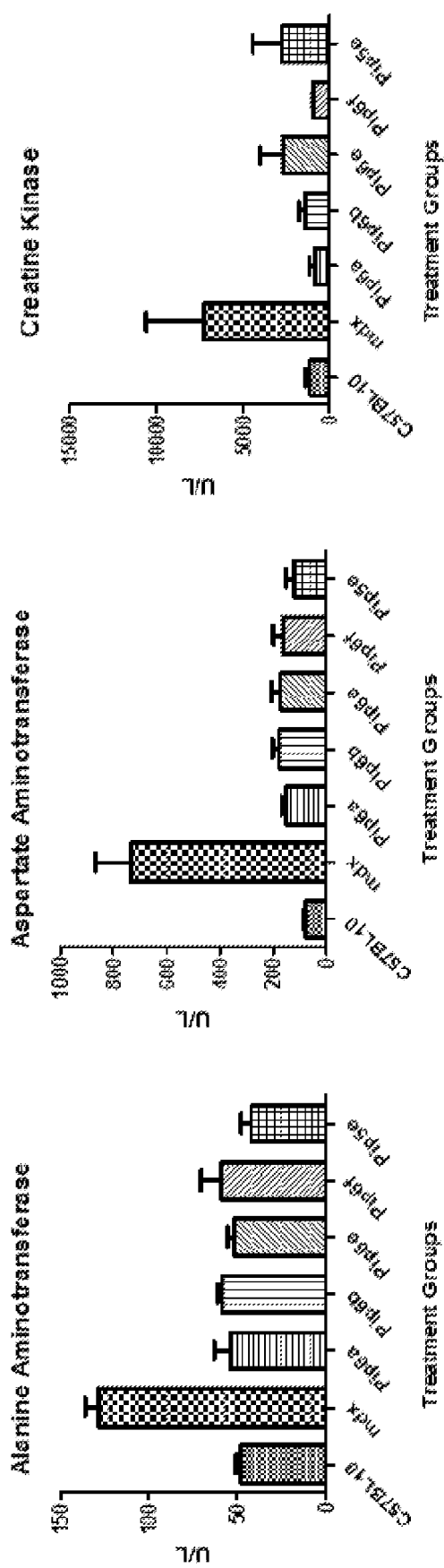
(FIG. 40a) Measurement of plasma alanine aminotransferase, aspartate aminotransferase and creatine kinase levels in C57BL10 control mice compared to mdx untreated and treated mice.
Figure 40B:
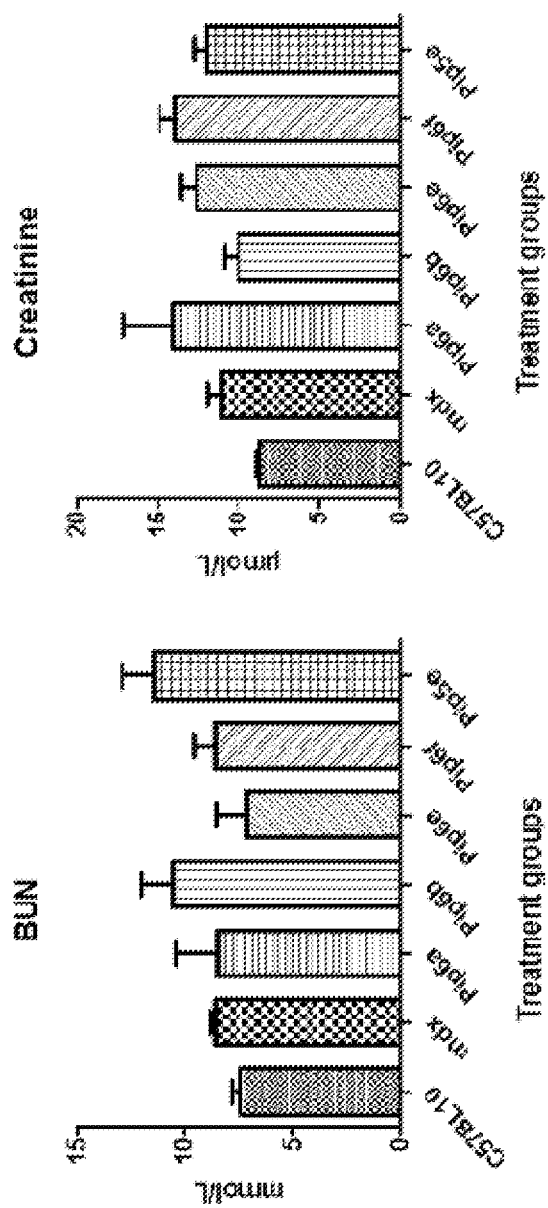
(FIG. 40b) Measurement of serum blood urea nitrogen (BUN) and creatinine levels in C57BL10 control mice compared to mdx untreated and treated mice.

In addition, these 5-aa core Pip6-PMOs do not exhibit evidence of toxicity, as assessed by plasma levels of relevant toxicity biomarkers, alanine aminotransferase (ALT), aspartate aminotransferase (AST) and creatine kinase (see FIG. 40a). Blood urea nitrogen and creatinine levels were similar to untreated mdx levels (see FIG. 40b). All Pip6-PMO treatment groups exhibit similar biomarker levels to untreated C57BL10 controls.

As described above, Pip5e-PMO was compared to Pip6-PMO conjugates for exon skipping and dystrophin production in adult mdx mice (4.5 months old) treated with a single intravenous injection of 12.5 mg/kg and body wide tissues were harvested 2 weeks later.

Immunohistochemical staining (data not shown) was used to visualise the production of dystrophin protein (and its correct re-location at the sarcolemma) and RT-PCR was used to detect exon-skipped products in treated mdx muscle groups. qPCR allows for the quantification of the spliced product and Western blots were used to quantify the amount of dystrophin protein produced in muscles from treated mdx mice as compared with C57BL10 and untreated mdx controls.

The results (FIGS. 6-17) showed that Pip-6a (containing an inverted core (Domain 2) sequence from Pip-5e), Pip-6b (Y changed to I in the core sequence), Pip-6e (R moved into the core sequence) and Pip-6f (containing a scrambled core sequence) all maintained the exon skipping and dystrophin production in heart muscle similarly to Pip-5e, whereas peptides containing a truncated core sequence (Pip-6c and Pip-6d) lost activity in heart muscle. Activity in all other muscle types was broadly similar for all six Pip-6(a, b, c, d, e, f) PMO constructs.

These results indicate that for efficient delivery of PMODMD to heart muscle the peptide sequence is not important, which suggests there is not a specific cell entry signal (e.g. scrambled core: Pip-6f exhibits good delivery of PMODMD to heart muscle). Thus, whilst retention of a 5 amino acid hydrophobic core sequence is important, the N- to C-order (primary sequence) of that hydrophobic core sequence is not important as demonstrated by inversion and scrambling of the core sequence without loss of activity in heart muscle compared to Pip-5e. However, for delivery to other muscle types, e.g. skeletal and smooth muscle, the requirement to have a 5 amino acid hydrophobic core sequence is less important, as demonstrated by good activity in non-cardiac muscle by Pip-6c and Pip-6d.

Cell Viability Assay

Huh-7 cells were grown at 37° C. under 5% $CO_2$/95% air atmosphere in DMEM supplemented with 10% fetal bovine serum and penicillin/streptomycin antibiotics. Cells were treated with trypsin and plated at $1.5 \times 10^4$ cells per well in 96 well plates. After overnight incubation cells were washed with PBS and PMO-Peptide conjugates in 50 µl OptiMEM were added to the wells in triplicate. After 4 hours incubation, conjugates were removed by replacement of media with 100 µl DMEM/10% FBS for a further 20 h incubation. 20 µl of MTS Cell Viability Assay (Promega) solution was added to the wells containing 100 µl DMEM and plates were incubated for 1-2 hours before the UV measurements at 490 nm were taken. The cell viability percentage was determined by normalizing the average absorbance of triplicate samples to the mean of untreated samples.

Results presented (FIGS. 19-22) are the average of two independent experiments, and are consistent with increased cell viability (i.e. lower cellular toxicity) of peptides containing fewer Arginine residues. For example, peptides having a total of 7 Arginine residues in Domains 1-3 combined exhibited higher cell viability (lower cellular toxicity) than peptides having 8 or 9 Arginine residues.

Serum Stability of Pip-PMO Conjugates

Serum stability was measured by adding an aliquot of Pip-PMO (10 nmoles) to 100% mouse serum (100 µL) and incubating at 37° C. for 120 or 240 min. Each reaction was diluted with IM guanidinium-HCl solution (300 µL) and ice-cold acetonitrile (600 µL). Samples were mixed and kept at −20° C., and the precipitated serum proteins separated by centrifugation (13000 rpm, 5 min). After centrifugation, the supernatant was collected, lyophilized and the residue dissolved in water for analysis for peptide degradation by MALDI-TOF mass spectrometry and by reversed phase HPLC. HPLC conditions were: Column, C18 reversed-phase (250×4.6 mm); Solvent A, 0.1% TFA, Solvent B, 90% Acetonitrile, 10% solvent A; Gradient, 10%-50% solvent B in 25 minutes. The results showed that for Pip5e-PMO, Pip6a-PMO, Pip6e-PMO and Pip6f-PMO at 120 minutes, the main component remaining could be identified as the unchanged Pip-PMO conjugate and that the levels of PMO conjugated to fragments of peptide were very similar to that for (RXRRBR)$_2$ XB-PMO.

Partial Deletions of the Hydrophobic Core of Pip6-PMO Conjugates Abolish Heart Dystrophin Production In addition to the need to identify Pip-PMOs with high efficiency and cardiac delivery, it was a further aim to better define those elements of the hydrophobic core of Pip peptides that are important for heart delivery. To this end, Pip peptides containing partial deletions of the hydrophobic core by 1 amino acid (removal of tyrosine; Pip6c) and by 2 amino acids (removal of isoleucine and tyrosine; Pip6d) were synthesised as PMO conjugates.

Figure 35A:
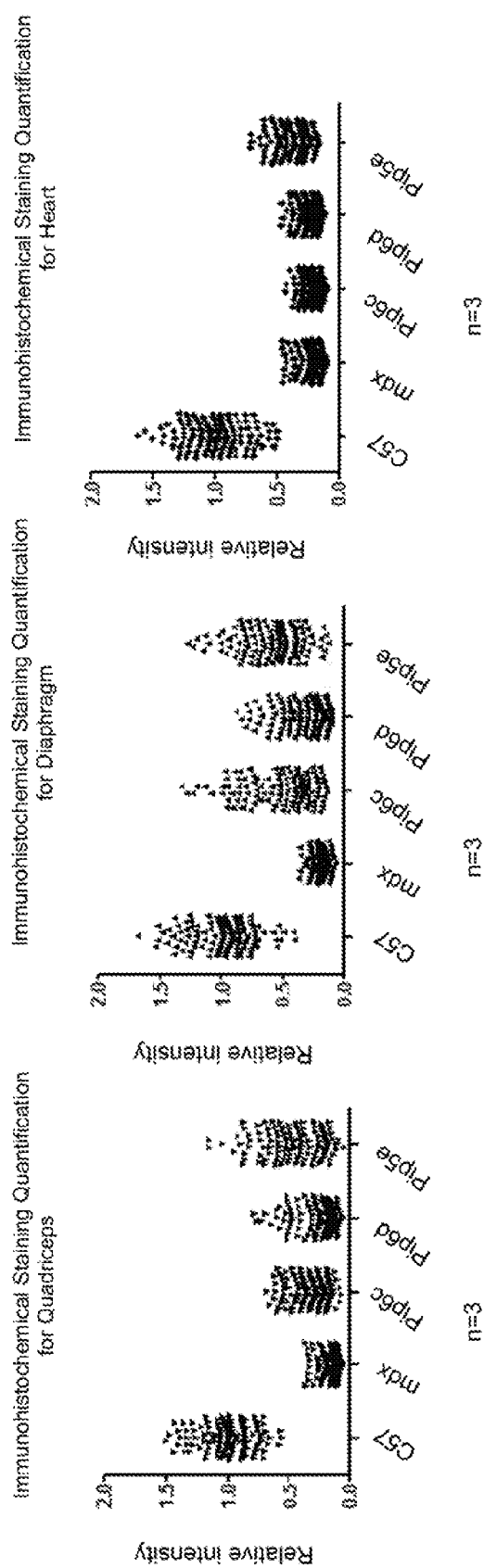
(FIG. 35a) Quantification of dystrophin immunohistochemical staining relative to control laminin counter-stain in quadriceps, diaphragm and heart muscles of C57BL10, mdx untreated and mdx treated mice. Relative intensity values for each region of interest (120 regions) are plotted and the model estimate average calculated (presented in FIG. 35b) from the repeated measures, multi-level statistical model. For statistical significance tables see FIGS. 31 & 32. Percentage recovery score is represented below.
Figure 35B:
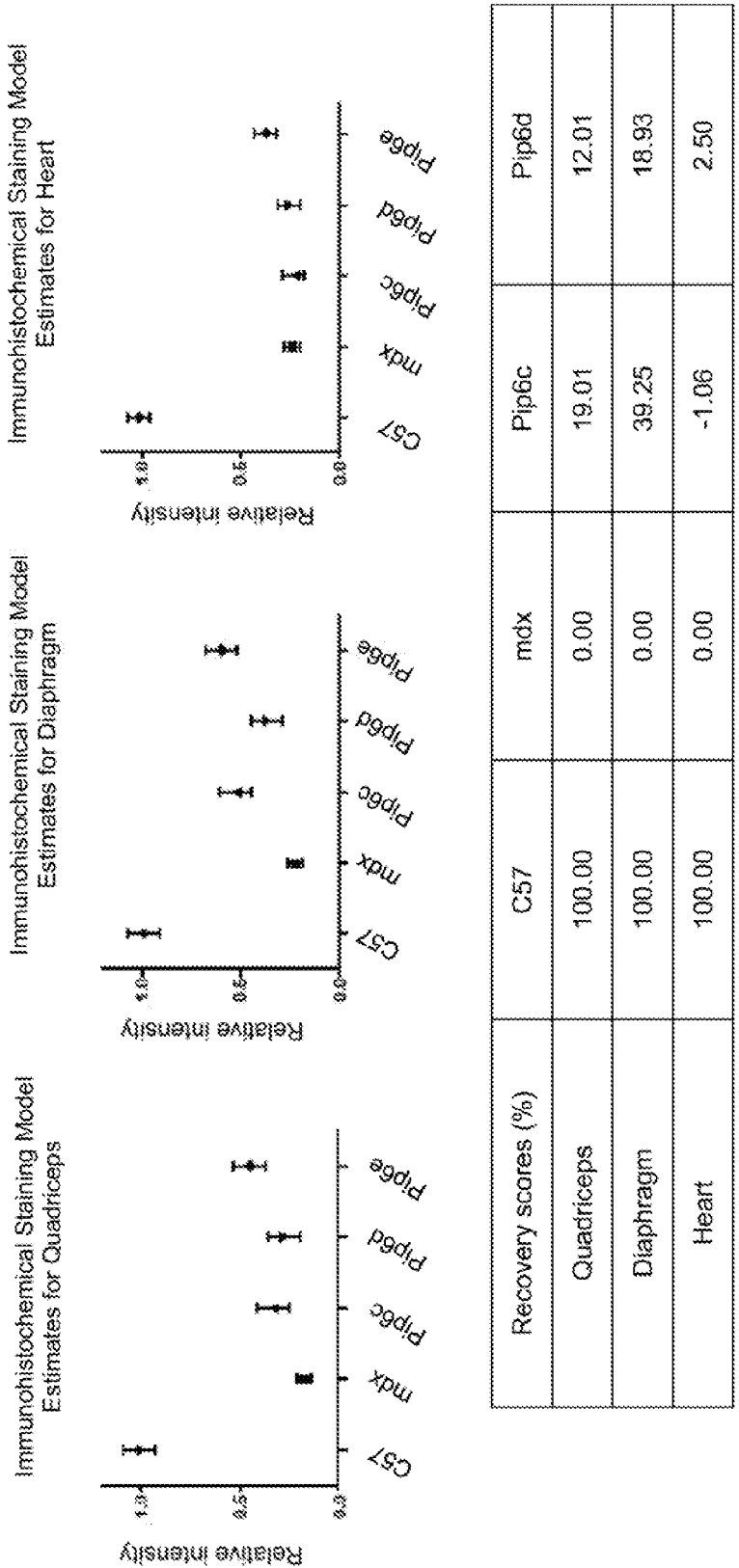
FIG. 35. Dystrophin splicing and protein restoration in C57BL10 control, mdx untreated and the shortened hydrophobic core Pip6-PMO treated mice (Pip6c and Pip6d) compared to Pip5e-PMO following a single 12.5 mg/kg, IV injection.
(FIG. 35c) Percentage Δ23 exon skipping as determined by quantitative real time (q-RT)-PCR in quadriceps, diaphragm and heart muscles.
(FIG. 35d) Representative real time (RT)-PCR images demonstrating exon skipping (skipped) in TA, quadriceps, gastrocnemius, diaphragm, heart and abdomen muscles. The top band indicates full length (FL) or un-skipped transcript.
(FIG. 35e) Representative western blot images for each treatment. Ten micrograms of total protein was loaded (TA, quadriceps, gastrocnemius, diaphragm, heart and abdomen muscles) relative to 50% (5 μg protein) and 10% (1 μg) C57BL10 controls, and normalised to α-actinin loading control (for quantification see FIG. 38a).

Following treatment of mdx mice, immunohistochemical staining was performed and this revealed some dystrophin expression in skeletal muscles such as the TA and diaphragm for both these deletion Pip6-PMOs. Quantification of the immunohistochemical staining revealed the lowest dystrophin restoration in the quadriceps with Pip6d-treatment, closely followed by Pip6c-PMO when compared to the other Pip6-PMOs (FIG. 35a, b and FIG. 31). Similarly, Pip6d-PMO displayed the lowest dystrophin restoration in the diaphragm. The recovery scores for Pip6c- and Pip6d-PMO conjugates in the heart were very low, indicating their poor efficiency (Pip6c % RS −1.06% and Pip6d 2.50%; FIG. 35b).

Figure 35C:
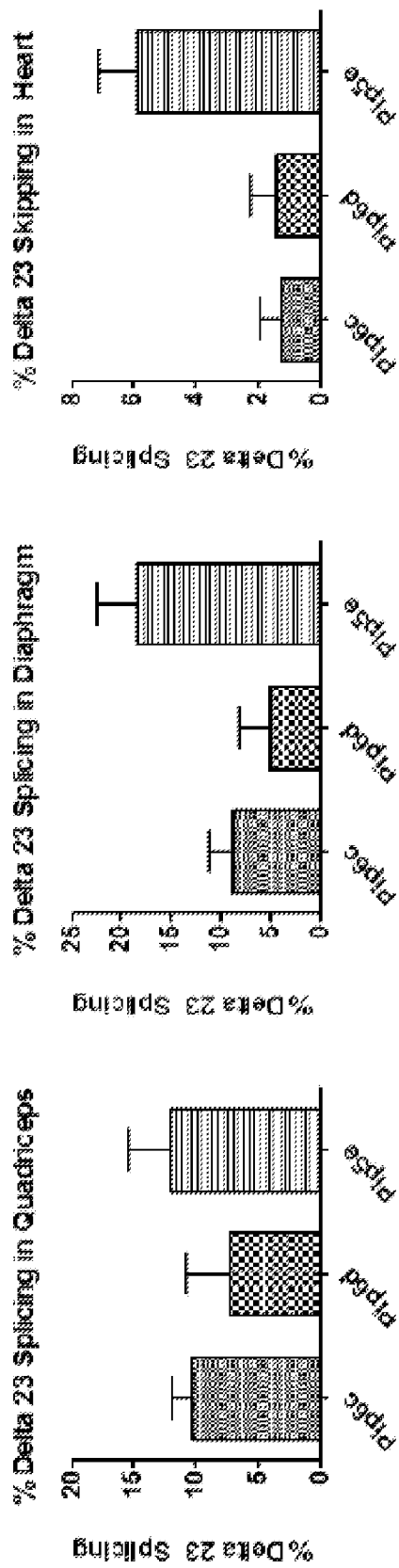
Figures 35D, 35E:
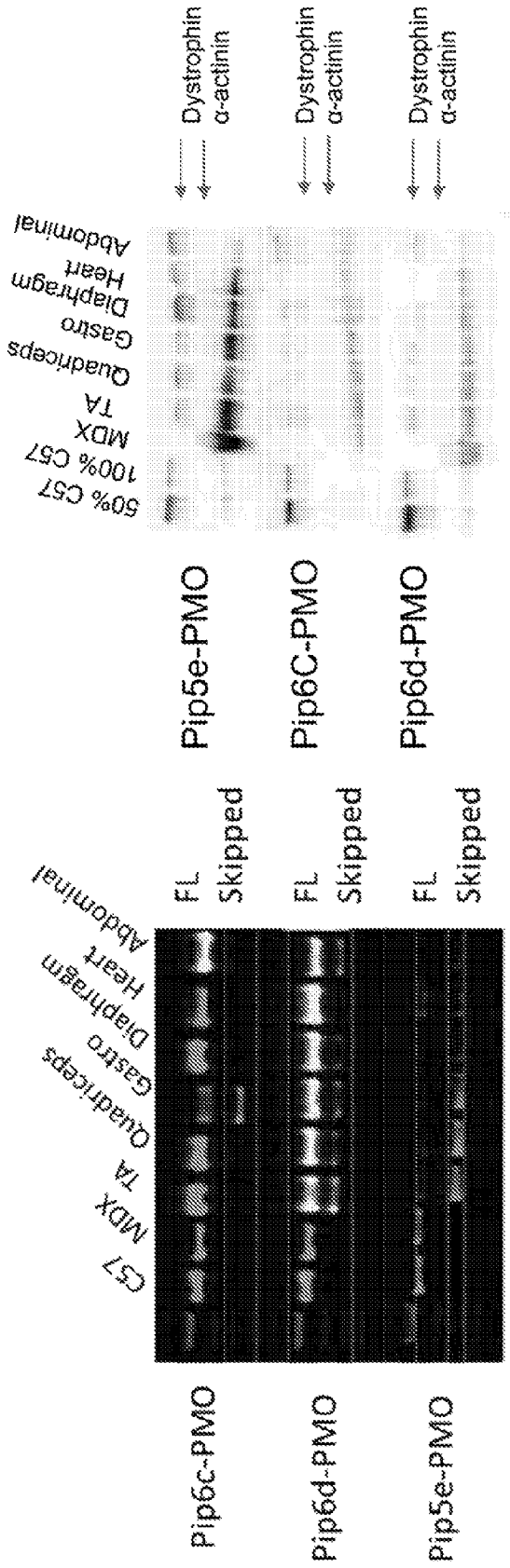
Figures 38A, 38B:
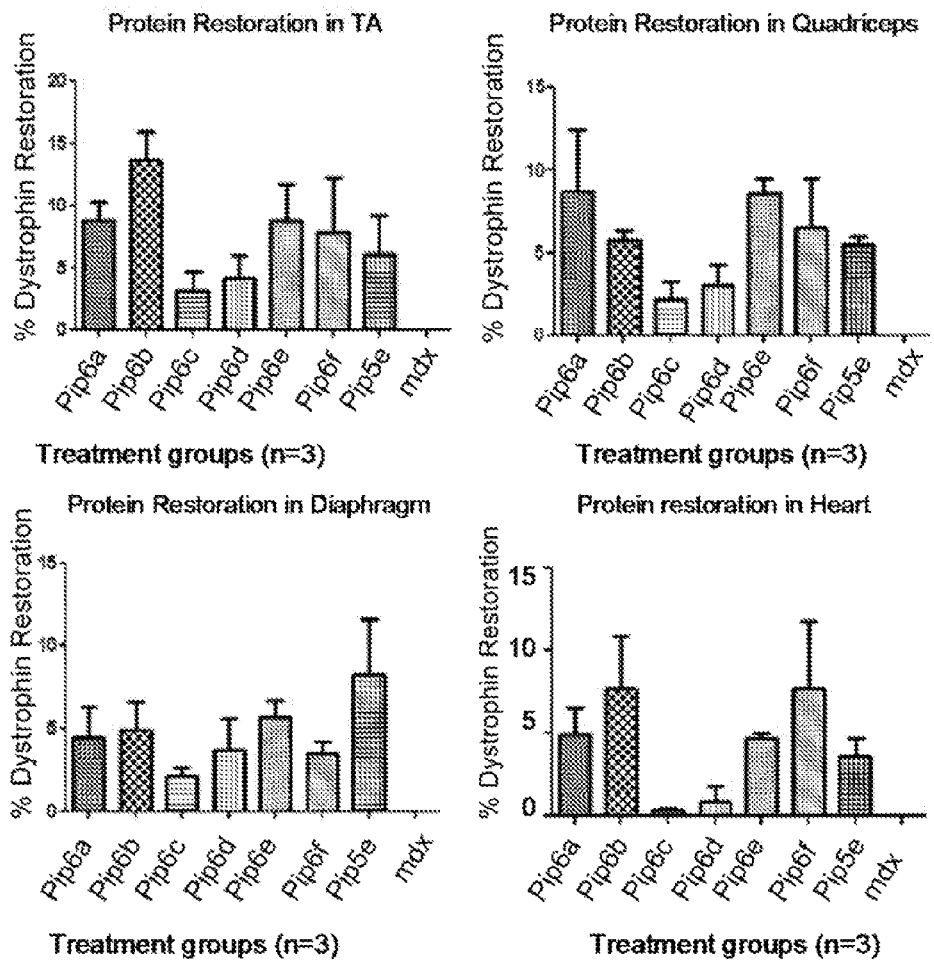
(FIG. 38a) Mean q-RT-PCR percentage values for Pip6-PMO treated mdx mice.
(FIG. 38b) Quantification of western blots for the TA, quadriceps, diaphragm and heart tissues of Pip6a-f treatments was calculated. A western blot for each mouse for all treatments (n=3) was performed and quantified against a 50% and 10% C57BL10 control which was averaged.

These results are corroborated by the PCR and western blot analyses. The RT-PCR representative images (FIG. 35d) and the qRT-PCR exon skipping results (FIG. 35c) both indicate reduced exon skipping in mdx mice treated with Pip6c- and Pip6d-PMO conjugates in quadriceps and diaphragm and negligible exon skipping in the heart. Western blot analysis revealed inefficient dystrophin protein production in the TA and quadriceps muscles and negligible dystrophin restoration in the heart (FIG. 35e and FIG. 38b).

These results show that the length of the hydrophobic core is crucial not only for good heart dystrophin production but also for activity in some other muscle groups. Therefore the arginine content of the CPP alone is not the sole predictor of dystrophin production and exon skipping efficiency for this class of peptides.

Altering the Position of Arginine in the Hydrophobic Core or Adding a Second Arginine is Detrimental to Dystrophin Production The repositioning of an arginine from a flanking region into the core was unexpectedly tolerated (Pip6e-PMO). Two further Pip6-PMO conjugates were thus synthesized as derivatives of Pip6e-PMO. Pip6g-PMO contained a second arginine residue, which was moved from the second flanking region into the central hydrophobic core, and Pip6h-PMO contains an inversion of the Pip6e hydrophobic region, such that the single arginine location is altered within the core.

Figure 36A:
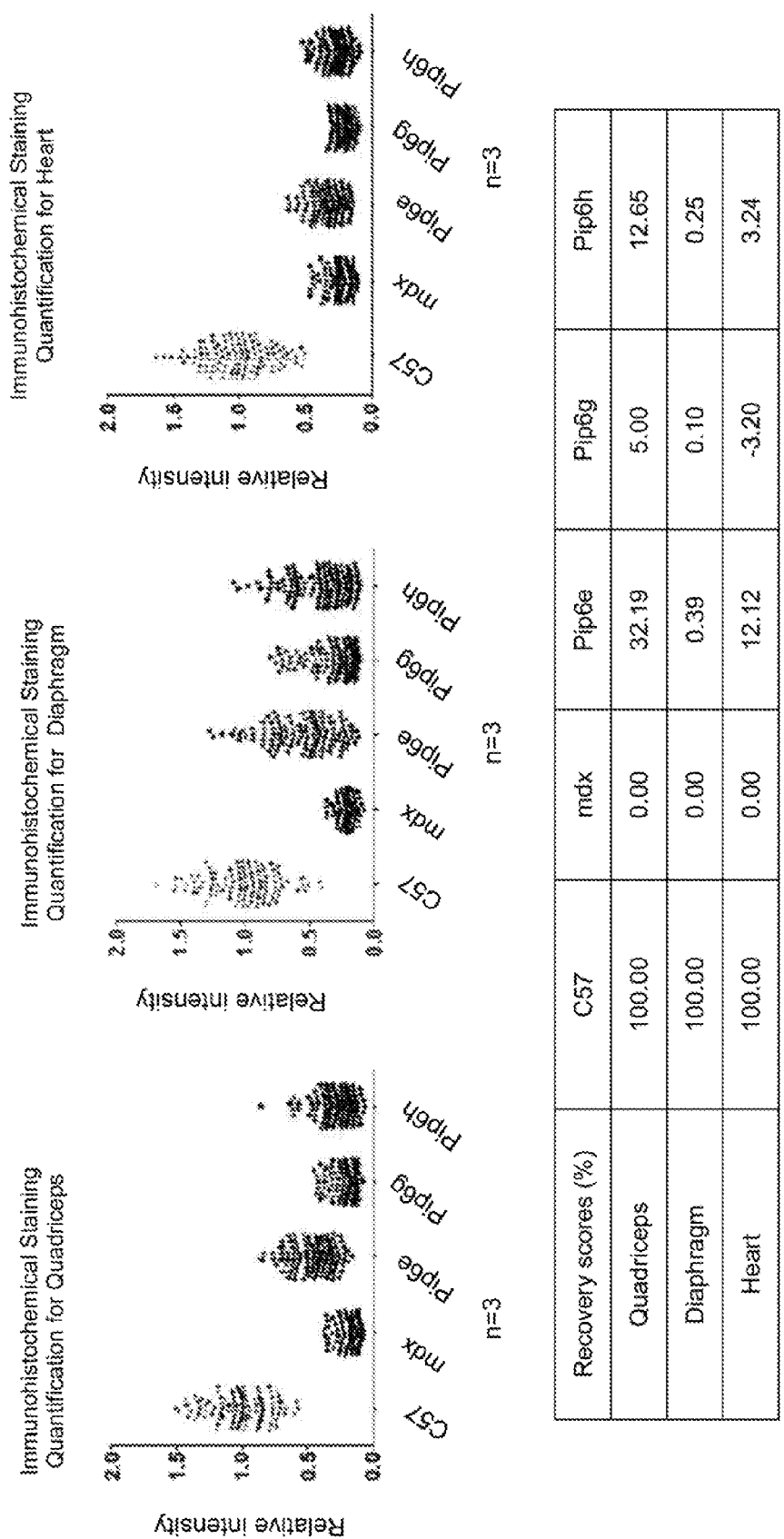
(FIG. 36a) Quantification of dystrophin immunohistochemical staining relative to laminin counter-stain in quadriceps, diaphragm and heart muscles of C57BL10, mdx untreated and mdx treated mice. Relative intensity values for each region of interest (120 regions) are plotted and the model estimate averages calculated (presented in FIG. 36b) from the repeated measures, multi-level statistical model. For statistical significance tables see FIG. 39a, b. Percentage recovery score is represented below.
Figure 36B:
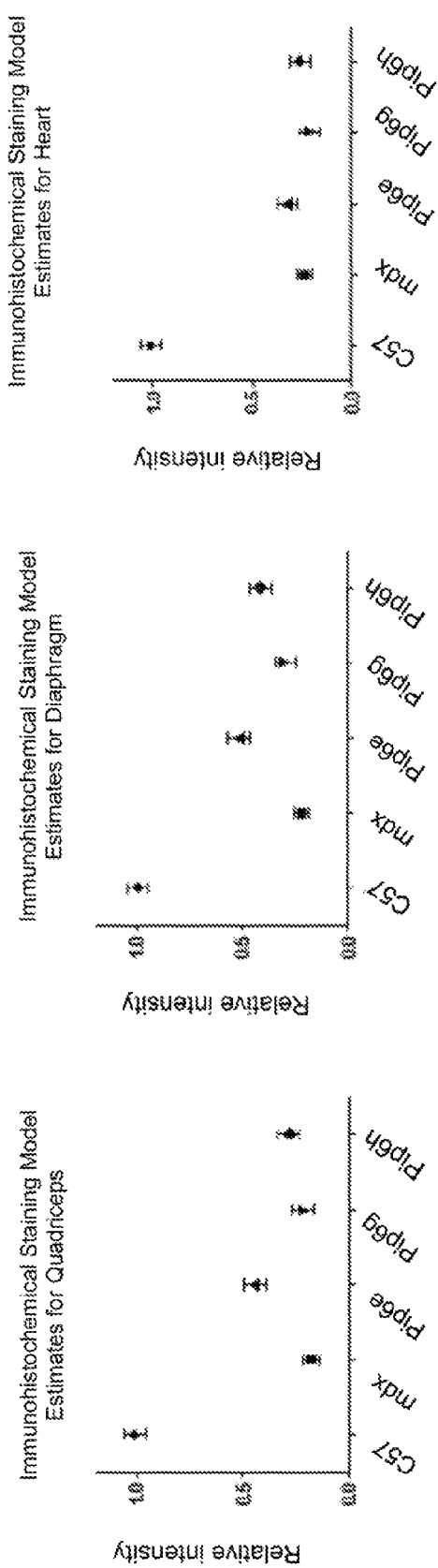
FIG. 36. Dystrophin splicing and protein restoration in C57BL10 control, mdx untreated and the Pip6e-PMO derivatives, Pip6g and Pip6h, following a single 12.5 mg/kg, IV injection. Immunohistochemical staining for dystrophin in C57BL10 control, mdx untreated and Pip6g and Pip6h-PMO treated mice was performed in TA, quadriceps, gastrocnemius, diaphragm, heart and abdomen muscle groups for C57BL10, mdx untreated and mdx treated mice.
(FIG. 36c) Percentage Δ23 exon skipping as determined by quantitative real time (q-RT)-PCR in quadriceps, diaphragm and heart muscles.
(FIG. 36d) Representative real time (RT)-PCR images demonstrating exon skipping (skipped) in TA, quadriceps, gastrocnemius, diaphragm, heart and abdomen muscles. The top band indicates full length (FL) or un-skipped transcript.
(FIG. 36e) Representative western blot images for each treatment. Ten micrograms of total protein was loaded (TA, quadriceps, gastrocnemius, diaphragm, heart and abdomen muscles) relative to 50% (5 μg protein) and 10% (1 μg) C57BL10 controls, and normalised to α-actinin loading protein (for quantification see FIG. 39c).
Figure 36C:
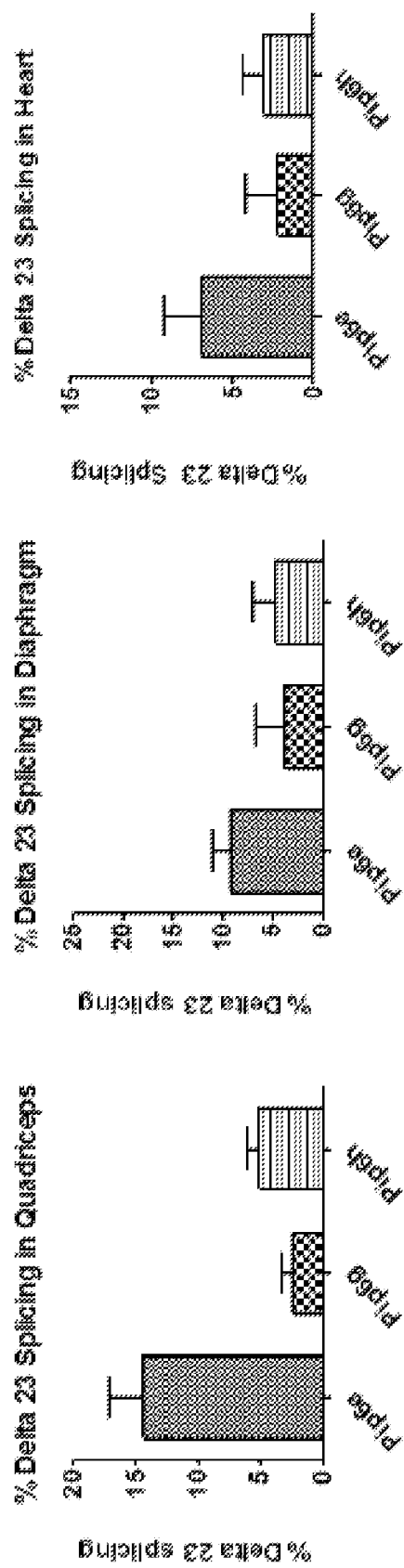
Figure 39D:
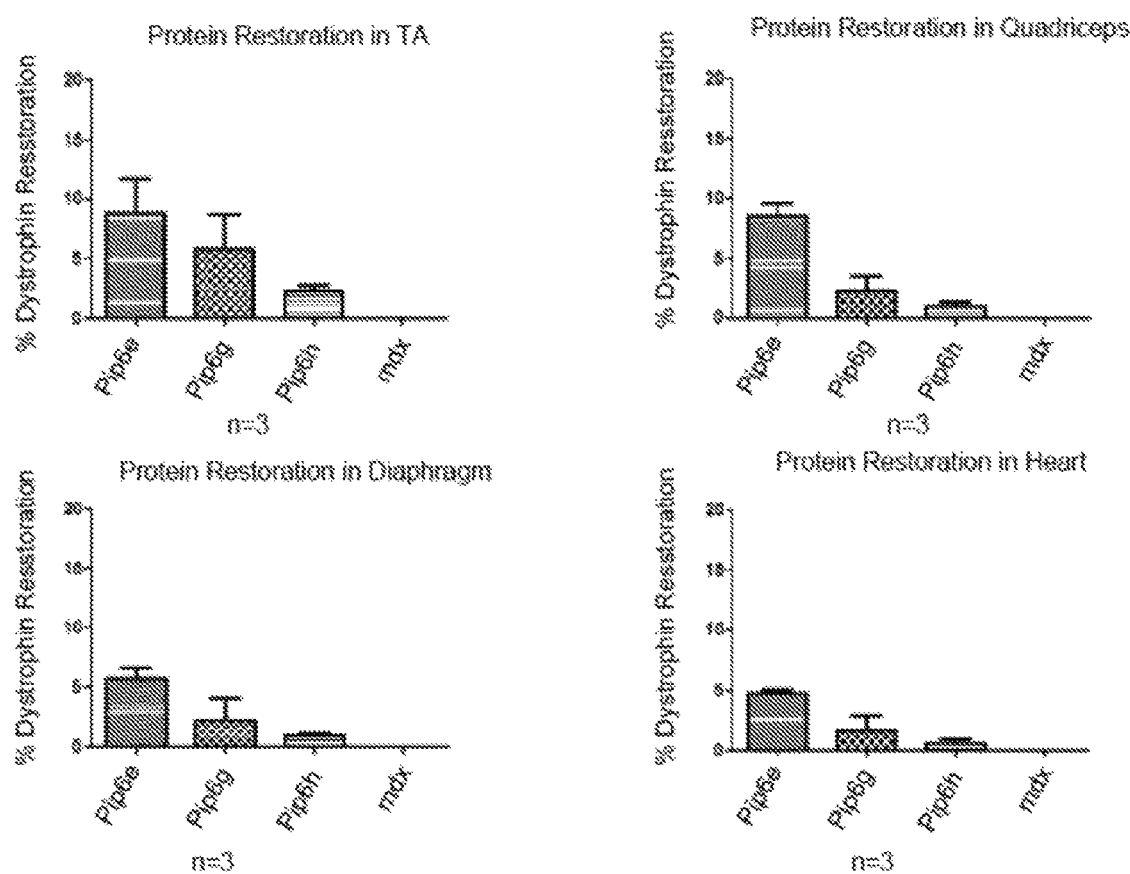
(FIG. 39d) Quantification of western blots for the TA, quadriceps, diaphragm and heart tissues of Pip6g and Pip6h were calculated. A western blot for each mouse for all treatments (n=3) was performed and quantified against a 50% and 10% C57BL10 control which was averaged.

Surprisingly, these changes to the hydrophobic core resulted in further reductions in dystrophin expression not only in heart but also in all other tissues, as observed in the immunohistochemical staining and in the quantifications thereof (FIG. 36a, b). The immunohistochemical staining representative images revealed very few dystrophin positive fibres in all tissues with the exception of the TA and quadriceps. With reference to the quantifications, Pip6g-PMO was not significantly different to untreated mdx in the quadriceps or diaphragm (FIG. 39a). Both Pip6e-PMO derivatives were not significantly different to untreated mdx in heart muscles, illustrating the general inefficiency of these two peptides. Similarly, these Pip6e-PMO derivatives showed reduced efficiency in exon skipping, as illustrated in representative RT-PCR images (FIG. 39d) and in qRT-PCR analyses (FIG. 36c and FIG. 39c) in all tissues. Western blots revealed negligible dystrophin protein restoration (FIG. 36e and FIG. 39d) in all tissues with the exception of the TA muscle. These data show that an increase in the number of arginines or alteration in the location of the single arginine in the hydrophobic region of Pip6e are detrimental to both heart as well as skeletal muscle dystrophin production.

Materials and Methods

Synthesis of Peptide-PMO Conjugates

Peptides were synthesized by standard Fmoc chemistry and purified by HPLC. The PMO sequence (5'-GGC-CAAACCTCGGCTTACCTGAAAT-3' [SEQ ID NO: 310]) was purchased from Gene Tools LLC. Peptides were conjugated to PMO through an amide linkage at the 3' end of the PMO, followed by purification by HPLC and analysed by MALDI-TOF MS as previously described in preliminary communication [Saleh A F, A.A.A., Yin H, Betts C, Hammond S, Wood M J A and Gait M J, *Enhancement of exon skipping and dystrophin production by 3'-peptide conjugates of morpholino (PMO) oligonucleotides in a mdx mouse model of Duchenne muscular dystrophy in Collection Symposium Series, Chemistry of Nucleic Acid Components*. 2011, Institute of Organic Chemistry and Biochemistry, Academy of Sciences of the Czech Republic: Prague. p. 292-296]. Peptide-PMO conjugates were dissolved in sterile water and filtered through a 0.22 μm cellulose acetate membrane before use.

Conjugates of PMO of Pip6a, Pip6b, Pip6e and Pip6f were found to be predominantly stable and of similar stability to Pip5e-PMO in 100% serum for 2 h at 37° C., as seen by HPLC and MALDI-TOF mass spectral analysis. The conjugates all showed similar degradation patterns, and intact conjugates were still observed up to 4 h, (data not shown).

In Vitro Assays: Exon Skipping in Mdx Mouse Myotubes

H2K mdx myotubes were prepared and incubated with peptide-PMO conjugates in the absence of any transfection agent at concentrations of 0.125, 0.25, 0.5 and 1.0 μM by the method described previously [Yin, H., et al., *Pip5 transduction peptides direct high efficiency oligonucleotide-mediated dystrophin exon skipping in heart and phenotypic correction in mdx mice*. Mol Ther, 2011. 19(7): p. 1295-303.]. The products of nested RT-PCR from total isolated RNA were examined by electrophoresis on a 2% agarose gel. Quantification of Δ23 transcript levels was calculated using densitometry. The MTS cell viability test (Promega) showed 100% survival at the highest concentrations of peptide-PMO conjugates used in the study (data not shown).

Animals and Intravenous Injections

Four and a half month old to 5½ month old mdx mice were used in these experiments (n=3). The experiments were carried out in the Biomedical Sciences Unit, University of Oxford according to procedures authorised by the UK Home Office. Pip6-PMO conjugates were prepared in 0.9% saline solution at a final dose of 12.5 mg/kg. The 160 μl total volume was administered via the tail vein of anaesthetised mice. Two weeks later mice were sacrificed by $CO_2$ inhalation, and muscles and other tissues harvested and snap-frozen in cooled isopentane before storage at −80° C.

Immunohistochemistry and Quantification of Dystrophin Expression

Transverse sections of tissue samples were cut (8 μm thick) for the examination of dystrophin expression. For dystrophin visualisation and quantification, sections were co-stained with rabbit-anti-dystrophin (Abcam) and rat anti-laminin (Sigma), and detected by goat-anti-rabbit IgG Alexa 594 and goat-anti-rat IgG 488 secondary antibodies respectively (Invitrogen). Images were captured using a Leica DM IRB microscope and Axiovision software (Carl Zeiss). Quantitative immunohistochemistry was performed as previously described [Malerba, A., et al., *Chronic systemic therapy with low-dose morpholino oligomers ameliorates the pathology and normalizes locomotor behavior in mdx mice*. Mol Ther, 2011. 19(2): p. 345-54; Arechavala-Gomeza, V., et al., *Immunohistological intensity measurements as a tool to assess sarcolemma-associated protein expression*. Neuropathol Appl Neurobiol, 2010. 36(4): p. 265-74.]. A representative image for each treatment was taken. For quantification, 4 representative frames of the dystrophin and correlating laminin were taken for each section (n=3) of the quadriceps, diaphragm and heart for each treatment. Using ImagePro software, 10 regions of interest were randomly placed on the laminin image which was overlaid on the corresponding dystrophin image. The minimum and maximum fluorescence intensity for 120 regions were recorded for each treatment. The intensity difference was calculated for each region to correct for background fluorescence and untreated mdx and treated mdx were normalised to C57BL10. These values were plotted on a scatter graph. The 'relative intensity means' were calculated using a multi-level statistics model. Using these values, the percentage recovery score was calculated by implementing the following equation, as described by Gillis, J-M.[47] (dystrophin recovery of treated mdx mice-dystrophin recovery of untreated mdx mice)/(dystrophin recovery of C57BL10 mice-dystrophin recovery of untreated mdx mice). Staining of dystrophin associated proteins was performed as previously described [Yin, H., et al., *Pip5 transduction peptides direct high efficiency oligonucleotide-mediated dystrophin exon skipping in heart and phenotypic correction in mdx mice*. Mol Ther, 2011. 19(7): p. 1295-303] using a MOM blocking kit (Vector Labs) and α-sarcoglycan and α-dystroglycan (Novocastra) antibodies (1:100 dilution). nNOS staining was performed using a goat anti-rabbit antibody (Abcam).

Exon Skipping in Mdx Mouse Tissues

Total RNA was extracted from control and treated mouse tissues using TRIzol reagent (Invitrogen) following manufacturer's instructions.

RT-PCR:

Four hundred nanograms of RNA template was used in a 50 µl reverse transcription reaction using One Step RT-PCR Kit (QIAGEN) and gene specific primers (Ex 20-26, Fwd: 5'-CAG AAT TCT GCC AAT TGC TGA G-3' [SEQ ID NO: 312], Rev: 5'-TTC TTC AGC TTG TGT CAT CC-3' [SEQ ID NO: 313]). Cycle conditions: 50° C. for 30 minutes, followed by 30 cycles of 30 sec at 94° C., 1 min at 58° C., and 2 min at 72° C. Two microliters of cDNA was further amplified in a 50 µl nested PCR (QIAGEN PCR kit) using the following cycle conditions: 94° C. for 30 seconds, 58° C. for 1 minute, and 72° C. for 1 min for 24 cycles (Ex 20-26: Fwd: CCC AGT CTA CCA CCC TAT CAG AGC [SEQ ID NO: 314], Rev: CCT GCC TTT AAG GCT TCC TT [SEQ ID NO: 315]). PCR products were examined by electrophoresis on a 2% agarose gel.

Quantitative Real Time PCR:

Two micrograms of RNA was reverse transcribed using a High Capacity cDNA Synthesis kit (Applied Biosystems). Exon skipping qPCR was performed using Syber green Kits (Applied Biosystems), primer sets (IDT) and the StepOne Plus Real-Time PCR system (Applied Biosystems). Primer sets used were as follows: total dystrophin transcripts, ex19-20: Fwd: GCCATAGCACGAGAAAAAGC [SEQ ID NO: 812], Rev: GCATTAACACCCTCATTTGC [SEQ ID NO: 813]; Delta23 dmd transcript, Fwd: GCG CTA TCA GGA GAC AAT GAG [SEQ ID NO: 814], Rev: GTT TTT ATG TGA TTC TGT AAT TTC CC [SEQ ID NO: 815]. Plasmids (total dystrophin and delta 23 skipped) were used for the standard curve.

Protein Extraction and Western Blot

Control and treated muscle samples were homogenised in lysis buffer comprising 75 mM Tris-HCl (pH 6.5) and 10% Sodium Dodecyl Sulphate complemented with 5% 2-mercaptoethanol. Samples were heated at 100° C. for 3 minutes before centrifugation and removal of supernatant. Protein levels were measured by Bradford assay (Sigma) and quantified using BSA standards. Ten to 15 µg of protein of untreated and treated mdx sample, and 50% and 10% of these concentrations of C57BL10 protein (positive control) were loaded onto 3-8% Tris-Acetate gels. Proteins were blotted onto PVDF membrane and probed for dystrophin using DYS1 (Novocastra) and loading control, α-actinin (Sigma), antibodies. Primary antibody was detected by binding of horseradish peroxidise-conjugated anti-mouse IgG with lumigen. Western blots were imaged (LiCOR Biosciences) and analysed using the Odyssey imaging system.

Clinical Biochemistry

Plasma samples were taken from the jugular vein of mdx mice immediately following sacrifice by $CO_2$ inhalation. Analysis of toxicity biomarkers was performed by a clinical pathology lab, Mary Lyon Centre, MRC, Harwell, UK.

Statistical Analysis

All data reported mean values±SEM. A multi-level, repeated measures model was implemented for this study. The multi-level statistical approach builds upon traditional statistical methods and is being increasingly implemented in the social, medical and biological sciences [Butterfield, A., et al., *PyEvolve: a toolkit for statistical modelling of molecular evolution*. BMC Bioinformatics, 2004. 5: p. 1; Brooks, G., et al., *Referral Source and Outcomes of Physical Therapy Care in Patients With Low Back Pain*. J Orthop Sports Phys Ther, 2012; Bernier, J., Y. Feng, and K. Asakawa, *Strategies for handling normality assumptions in multilevel modeling: a case study estimating trajectories of Health Utilities Index Mark 3 scores*. Health Rep, 2011. 22(4): p. 45-51; Winter, E. M., R. G. Eston, and K. L. Lamb, *Statistical analyses in the physiology of exercise and kinanthropometry*. J Sports Sci, 2001. 19(10): p. 761-75.]. The model used for this study takes into account the multiple 'relative intensity units' (level 1) for each mouse (level 2) for each treatment (level 3) as performed in the immunohistochemical staining quantification. In this example mdx untreated mice and Pip5e-PMO treated mice were applied as the constant/fixed parameter, to which the other treatments and wild-type control were compared. This was following a Box-Cox power transformation which was performed to ensure a normal distribution. Statistical analysis was performed using MLwIN version 2.25.

Synthesis of Peptides and Peptide-PMO Conjugates

Figure 37A:
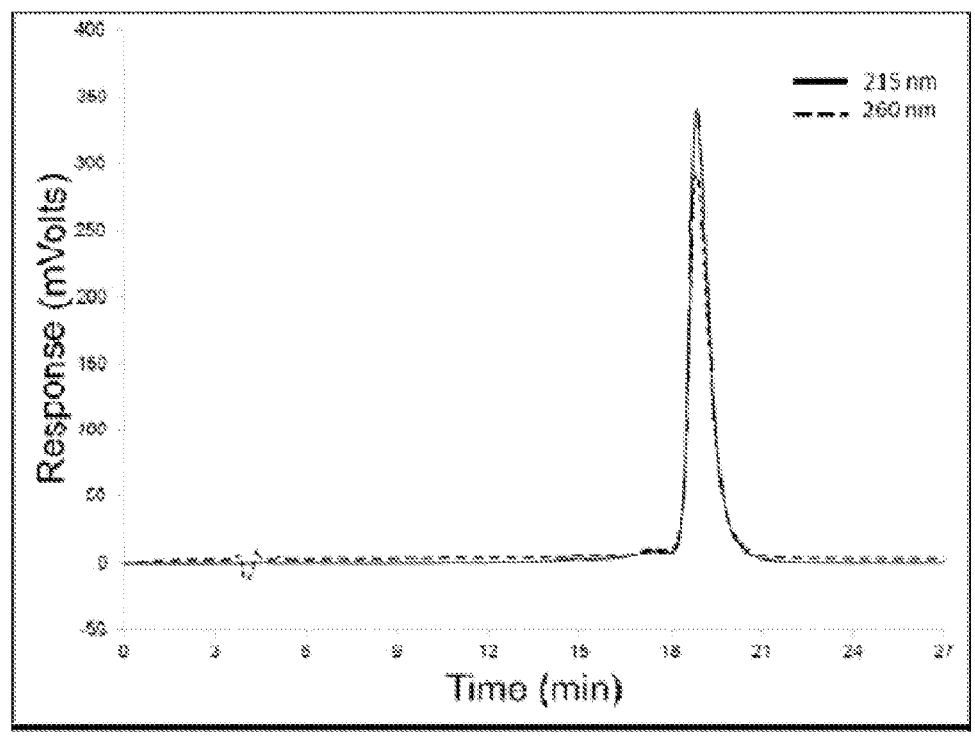
(FIG. 37a) Analytical reversed phase HPLC chromatogram of purified Pip6e-PMO conjugate on 4.6×250 mm C18 column (eluent A: 0.1% TFA, eluent B: 90% acetonitrile, 10% eluent A) using a gradient 10-50% B in 27 minutes (FIG. 37b) MALDI-TOF mass spectrum of Pip6e-PMO conjugate.
Figure 37B:
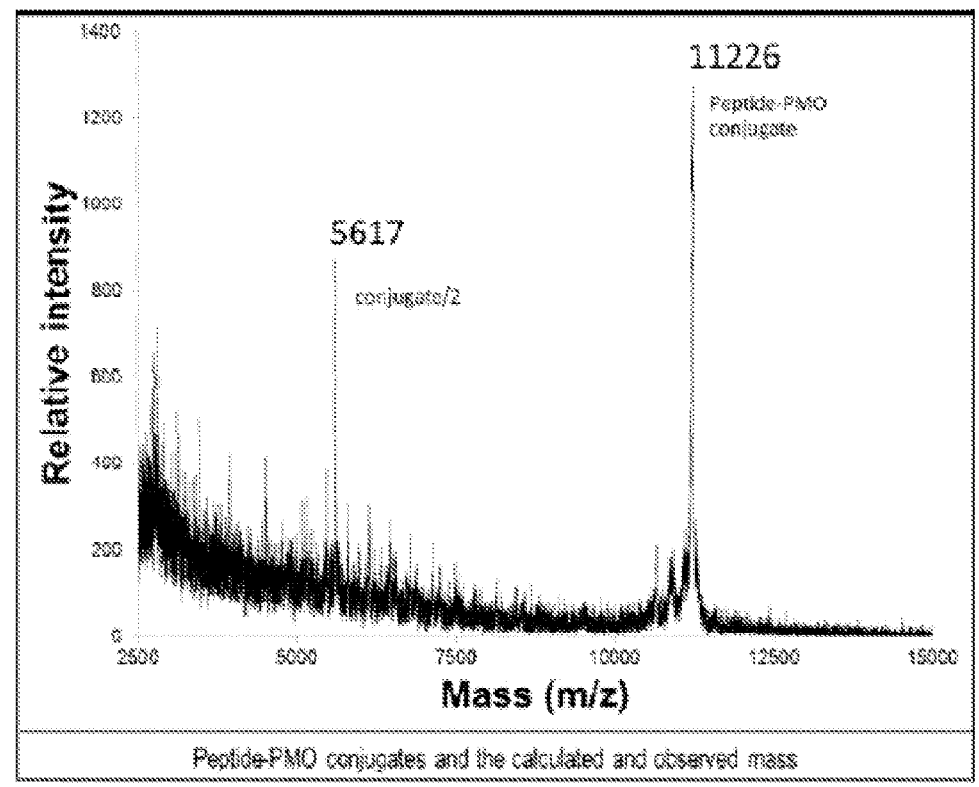
FIG. 37. HPLC chromatogram and MALDI-TOF data for Pip6e-PMO.
(FIG. 37c) Table of calculated and found molecular masses of Pip6-PMOs.

The PMO sequence (5'-GGCCAAACCTCGGCTTACCT-GAAAT-3' [SEQ ID NO: 310]) was purchased from Gene Tools LLC. Peptides were synthesized by standard 9-fluorenylmethoxy carbonyl (Fmoc) chemistry, using a Liberty Peptide Synthesizer (CEM) on 100 µmole scale, purified to >90% purity by standard reversed phase HPLC, and characterized by MALDI-TOF MS. Peptide-PMO conjugates were prepared on 200 nmole PMO scale via an amide linkage by attaching the carboxyl group at the C-terminus of peptide to the secondary amine at the 3'-end of the PMO (FIG. 1c). The C-terminal carboxylic acid of peptide (2.5-fold molar excess over PMO) was activated using 2-(1H-benzotriazole-1yl)-1,1,3,3-tetramethyluronium hexafluorophosphate (HBTU) and 1-hydroxybenzotriazole (HOBt) in 1-methyl-2-pyrrolidinone (NMP) and diisopropylethylamine (DIEA) using a HBTU:HOBt:DIEA (2.3:2.0:2.3) molar excess over peptide. The mixture was added to a solution of PMO (10 mM) dissolved in DMSO and incubated at 37° C. for 2 h. The mixture was then diluted with a 4-fold excess of water and purified on a cation exchange chromatography column (Resource S 6-ml column, GE Healthcare) using sodium phosphate buffer (buffer A: 25 mM $Na_2HPO_4$, 25% acetonitrile, pH 7.0), buffer B: 1 M NaCl, 25 mM $Na_2HPO_4$, 25% acetonitrile, pH 7.0), a flow rate of 4 ml/min and a gradient of 0-75% buffer B in 25 min to remove unconjugated PMO and excess peptide. The conjugates were then loaded onto an Oasis HLB column (4.6 mm×20 mm, Waters, Milford, Mass.), washed with water to remove salts and eluted with 60% (v/v) acetonitrile. The conjugate was lyophilized and analysed by MALDI-TOF MS and by HPLC (FIG. 37). Peptide-PMO conjugates were dissolved in sterile water and filtered through a 0.22 µm cellulose acetate membrane before use. Overall yields were 20-25% based on PMO.

Scale-Up of Peptide-PMO Synthesis

Conjugations were improved on a 1000 nanomole scale of starting PMO, keeping the same ratio for HBTU:HOBt:DIEA as described above. Conjugation reactions were carried out using a microwave oven (CEM Discover) and the temperature of reaction was increased to 65° C., leading to a decrease in reaction time to 15 min. The crucial purification steps were also improved in this process. The crude reaction mixture was purified by HPLC using a larger ion-exchange column (Source 15S, GE Healthcare, HR16/10, 18 ml bed volume) to remove the excess of peptide and unconjugated PMO, eluting with a solution of sodium chloride (NaCl, 1.0 M) in sodium phosphate buffer (pH 7.0) to obtain the chloride salt of the peptide-PMO. A desalting step was used to remove the excess NaCl on a custom-made Oasis HLB desalting column (Waters, 19×30 mm). After washing the column for 10-min with Millipore grade water (instead of HPLC-grade water), the PPMO was eluted with 60% (v/v) acetonitrile in water. 500 nanomoles were used in a single injection and yields were higher than using multiple injections (e.g. 2×250 nmol). This resulted in an increase in yield of this one-pot conjugation reaction to approx 40%.

Discussion

The most promising therapy to date for the severely debilitating neuromuscular disorder DMD is treatment with AOs, which restores the reading frame of the dystrophin pre-mRNA by exon skipping. Two AOs, a PMO [Cirak, S., et al., *Exon skipping and dystrophin restoration in patients with Duchenne muscular dystrophy after systemic phosphorodiamidate morpholino oligomer treatment: an open label, phase 2, dose-escalation study.* Lancet, 2011. 378(9791): p. 595-605; Miller, F., C. F. Moseley, and J. Koreska, *Spinal fusion in Duchenne muscular dystrophy.* Dev Med Child Neurol, 1992. 34(9): p. 775-86.] and a 2'OMe oligonucleotide [van Deutekom, J. C., et al., *Local dystrophin restoration with antisense oligonucleotide PRO051.* N Engl J Med, 2007. 357 (26): p. 2677-86; Goemans, N. M., et al., *Systemic Administration of PRO051 in Duchenne's Muscular Dystrophy.* N Engl J Med, 2011. 364(16): p. 1513-22.], are currently in clinical trials and the early promising results have increased hope for DMD patients. However, studies involving the administration of very high doses of naked PMO into mdx mice have shown only partial restoration of dystrophin in body-wide skeletal muscles and negligible correction in heart [Malerba, A., et al., *Chronic systemic therapy with low-dose morpholino oligomers ameliorates the pathology and normalizes locomotor behavior in mdx mice.* Mol Ther, 2011. 19(2): p. 345-54; Malerba, A., et al., *Dosing regimen has a significant impact on the efficiency of morpholino oligomer-induced exon skipping in mdx mice.* Hum Gene Ther, 2009. 20(9): p. 955-65.]. The necessity to correct dystrophin in the heart is ever more apparent following studies whereby the correction of the skeletal phenotype resulted in an increase in the cardiac workload and thus further progression of the cardiomyopathy [Malerba, A., L. Boldrin, and G. Dickson, *Long-term systemic administration of unconjugated morpholino oligomers for therapeutic expression of dystrophin by exon skipping in skeletal muscle: implications for cardiac muscle integrity.* Nucleic Acid Ther, 2011. 21(4): p. 293-8; Townsend, D., et al., *Emergent dilated cardiomyopathy caused by targeted repair of dystrophic skeletal muscle.* Mol Ther, 2008. 16(5): p. 832-5.]. The discovery that CPP-conjugated PMOs can achieve much more effective dystrophin correction in mdx mice than naked PMOs has brought renewed promise for enhanced AO efficacy by improving cellular and in vivo delivery.

We previously reported a promising peptide-PMO candidate, Pip5e-PMO, capable of restoring dystrophin protein to high levels in all muscle types, including heart, following a single 25 mg/kg administration [Yin, H., et al., *Pip5 transduction peptides direct high efficiency oligonucleotide-mediated dystrophin exon skipping in heart and phenotypic correction in mdx mice.* Mol Ther, 2011. 19(7): p. 1295-303.]. In addition to arginine-rich sequences, Pip peptides contain a 5-aa hydrophobic section not present in the previous B-peptide lead [Perez, F., et al., *Antennapedia homeobox as a signal for the cellular internalization and nuclear addressing of a small exogenous peptide.* J Cell Sci, 1992. 102 (Pt 4): p. 717-22.], which seemed likely to be responsible for the improved heart activity. The Pip6 series was developed as derivatives of Pip5e-PMO in an attempt to cast light on aspects of the hydrophobic core required for heart dystrophin production and also to identify even more active Pip-PMO conjugates. Our study using a moderate, single dose administration regimen has produced some surprising results.

A key finding is that maintenance of the five amino acid length of the hydrophobic core region is imperative for good heart dystrophin production. One might imagine that diminished efficiency of dystrophin restoration in the heart for Pip6c-PMO and Pip6d-PMO, with sequential amino acid deletions in the core, might be correlated with the resultant lower hydrophobicity and hence a reduced capacity to enter the cell [Gupta, A., et al., *Hydrophobicity drives the cellular uptake of short cationic peptide ligands.* Eur Biophys J, 2011. 40(6): p. 727-36.]. However, the in vitro results would suggest that all of these constructs are capable of entering the cells as they are all fully capable of exon skipping in muscle cells. Thus, the length of the 5-aa hydrophobic core must affect a different parameter essential for in vivo heart delivery. Enhanced uptake into whole heart slices of fluorescently labelled Pip5e-PMO, compared to B-PMO, suggested instead that crossing of another barrier (for example the endothelial lining to the heart) is improved [Yin, H., et al., *Cell-penetrating peptide-conjugated antisense oligonucleotides restore systemic muscle and cardiac dystrophin expression and function.* Hum Mol Genet, 2008. 17(24): p. 3909-18.]. Further heart studies are continuing with a Pip6-PMO that may help to address this issue. More surprising perhaps is that for Pip6c-PMO and Pip6d-PMO there was also some loss of dystrophin production in other muscle types. This suggests that the hydrophobic/cationic balance and/or the precise spacings of hydrophobic and cationic residues in the CPP impose more subtle effects on in vivo delivery parameters. Another clear conclusion arising from the Pip6-PMO analogues is that a specific order of hydrophobic residues within the hydrophobic core is less important at maintaining the heart dystrophin production, since an inverted sequence (Pip6a), a single substitution of an equally hydrophobic residue (Pip6b), and a scrambled sequence (Pip6f) were at least as active as Pip5e-PMO, and more efficient in heart and some muscle groups (FIG. 38).

These results provide evidence that the hydrophobic core of Pip peptides is unlikely to contain a particular amino acid sequence that recognises a specific receptor in a membrane barrier required to penetrate heart tissue, but instead the core acts as a hydrophobic spacer of some kind.

Most surprising however is that Pip6e-PMO did induce some dystrophin splicing and protein restoration in heart muscle as indicated by the western and qRT-PCR results (note: not significantly different in immunohistochemical staining quantification). In the Pip-6e peptide, one arginine residue is moved into the hydrophobic core, which also results in alignment of a hydrophobic X residue adjacent to the core (X-YRFLI [SEQ ID NO: 816]). One might have expected heart dystrophin production to have been completely lost in this conjugate, since a cationic amino acid (arginine) is now included in the core. By contrast, such heart activity was lost for Pip6h-PMO (X-ILFRY core [SEQ ID NO: 817]) and the double arginine core conjugate Pip6g-PMO (XYRFRLI-X core [SEQ ID NO: 818]). Unexpectedly, dystrophin production was also lost in quadriceps and diaphragm for both Pip6g- and Pip6h-PMO. The unanticipated inconsistencies within the activity results for Pip6e, Pip6g and Pip6h, and the losses of activities for Pip6c- and Pip6d-PMO, are perhaps best explained by the realisation that precise spacings of the arginine residue within the Pip peptides with respect to both the outer hydrophobic amino acid spacers (X and B) and the inner hydrophobic core residues may drastically alter the pharmacological properties of each conjugate. This might occur not only through alteration in cationic/hydrophobic balance but alternatively due to secondary or tertiary structure changes of the Pip-PMOs, which could in turn affect serum protein binding or another parameter that alters the circulatory half-life, or which could affect the ability to traverse barriers required to penetrate muscle tissues.

Several conjugates (Pip6a, Pip6b and Pip6f-PMOs) have shown promising dystrophin production activities even beyond that of the previous candidate, Pip5e-PMO. Interestingly, analysis of serum samples from one of the 5-aa Pip6-PMO treatments, Pip6e-PMO, showed partial normalisation of 3 miRNAs (miR-1, miR-133a and miR-206) to near wild type levels following a single, 12.5 mg/kg administration [Thomas C. Roberts, K.E.M.B., Graham McClorey, Samir E L Andaloussi, Caroline Godfrey, Corinne Betts, Thibault Coursindel, Michael J. Gait, and C.I.E.S.a. M. J. A. Wood, *Expression analysis in multiple muscle groups and serum reveals complexity in the microRNA transcriptome of the mdx mouse with implications for therapy*. Nucleic Acid Ther, 2012]). This is greatly promising for the Pip6-PMOs, as it would not be considered the optimal peptide yet still demonstrated the significant therapeutic effect of this group of peptides. These new leads provide a good basis for identification of a Pip-PMO candidate suitable for detailed physiological studies of muscle and heart function, as well as thorough toxicity profiling including dose escalation studies, in anticipation that one such Pip-PMO will proceed to clinical trial.

TABLE 1

Resource S ion exchange columns and purification parameters

| Amount to load | Column (bed volume) | Flow rate (ml/min) | Gradient |
|---|---|---|---|
| 50-200 µmol | 6 ml | 4 ml/min | 0 to 75% solvent B over 25 min |
| 2-10 µmol | 200 ml | 14 ml/min | 0 to 100% solvent B over 60 min |

The C-terminal carboxylic acid of peptide (2.5-fold molar excess over PMO) was activated using 2-(1H-benzotriazole-1yl)-1,1,3,3-tetramethyluronium hexafluorophosphate (HBTU) and 1-hydroxy-7-azabenzotriazole (HOAt) in 1-methyl-2-pyrrolidinone (NMP) and Diisopropylethylamine (DIEA) using a HBTU:HOBt:DIEA (2.3:2.0:2.3) molar excess over peptide (Table 2). The concentration of the peptide was 100 mM. After mixing, the mixture was added to a DMSO solution of PMO (10 mM) at 2.5:1 molar ratio and incubated at 37° C. for 2 hours. The mixture was then purified by a large cation exchange chromatography column (Resource S 200-ml column, GE Healthcare) using sodium phosphate buffers (buffer A: 25 mM $Na_2HPO_4$, 25% acetonitrile, pH 7.0), buffer B: 1 M NaCl, 25 mM $Na_2HPO_4$, 25% acetonitrile, pH 7.0), a flow rate of 14 ml/min and a gradient of 0-100% buffer B in 60 min, to remove unconjugated PMO and excess peptide.

TABLE 2

Amounts and volumes of reagents for Pip9b-PMO conjugation (10 µmole scale of PMO)

| Reagent | PMO (exon 23 mouse) | Pip9b | HBTU | HOAt | DIEA |
|---|---|---|---|---|---|
| Concentration | 10 mM in DMSO | 100 mM in NMP | 300 mM in NMP | 300 mM in NMP | d = 0.742 |
| Molecular weight | 8413 g/mol | 2414 g/mol | 379 g/mol | 136 g/mol | 126 g/mol |
| Amount | 10 µmol | 25 µmol | 57.5 µmol | 50 µmol | 57.5 µmol |
| Volume | 1 ml | 250 µl | 192 µl | 167 µl | 10 µl |

Example 2

Synthesis of Peptide-PMO Conjugates

Figure 33:
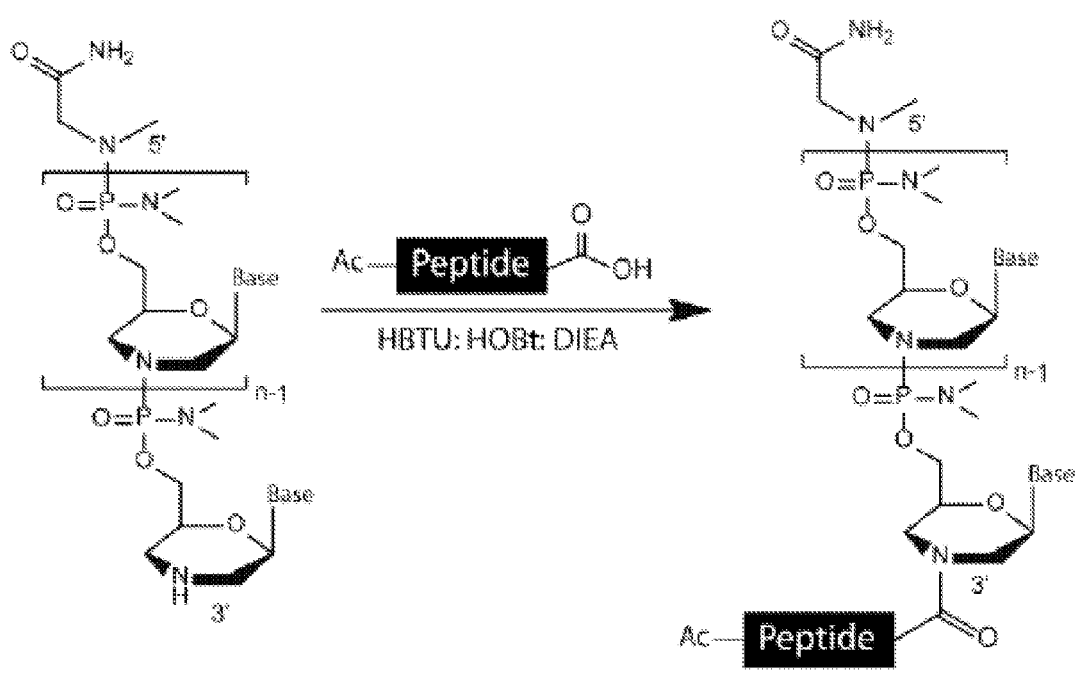
FIG. 33. Chemical conjugation method for Pip5e-PMO derivatives. Method of conjugation of peptide to PMO AO. Peptides were conjugated to PMO through an amide linkage at the 3' end of the PMO, followed by purification by HPLC and analysed by MALDI-TOF MS. HBTU: 2-(IH-benzotriazole-1-yl)-1,1,3,3-tetramethyluronium hexafluorophosphate, HOBt, 1-hydroxybenzotriazole monohydrate, DIEA: diisopropylethylamine.

The PMO sequence (5'-GGCCAAACCTCGGCTTACCT-GAAAT-3') [SEQ ID NO:310] was purchased from Gene Tools, LLC. Peptides were synthesized in house by standard 9-fluorenylmethoxy carbonyl (Fmoc) chemistry, purified to >90% purity, and characterized by MALDI-TOF MS. Peptide-PMO conjugates were prepared via an amide linkage by attaching the carboxyl group at the C-terminus of peptide to the secondary amine at the 3'-end of the PMO (FIG. 33). However, we made several modifications for conjugation and final purification of peptide-PMO including a) large scale conjugation reaction (up to 15 µmol of PMO), b) use of a larger scale ion exchange column for peptide-PMO purification from individual components (Table 1) and c) the use of Amicon Ultra-15 centrifugal filter device for desalting instead of the previously used reversed phase HPLC column. As a result, yields were more than doubled and were routinely 40-55% based on the PMO sequence.

The conjugates were then desalted using 3 kDa MWCO Amicon Ultra-15 centrifugal filter device (Millipore) by concentrating the sample (1 hour spin at 25° C., at 3220 rcf), then diluting the concentrate to 12 ml with $H_2O$. The process was repeated twice. The conjugate was lyophilized and analysed by MALDI-TOF MS and HPLC. Peptide-PMO conjugates were dissolved in sterile water (endotoxins free) and filtered through 0.22 µm cellulose acetate membrane before use. The concentration was measured by UV at 265 nm in 0.1 N HCl using the extinction coefficient of the PMO as provided in the data sheet from Gene Tools.

Example 3

Pip7-9 Peptides

Toxicity Evaluation of Pip7-9-PMO In Vitro

Figure 42:
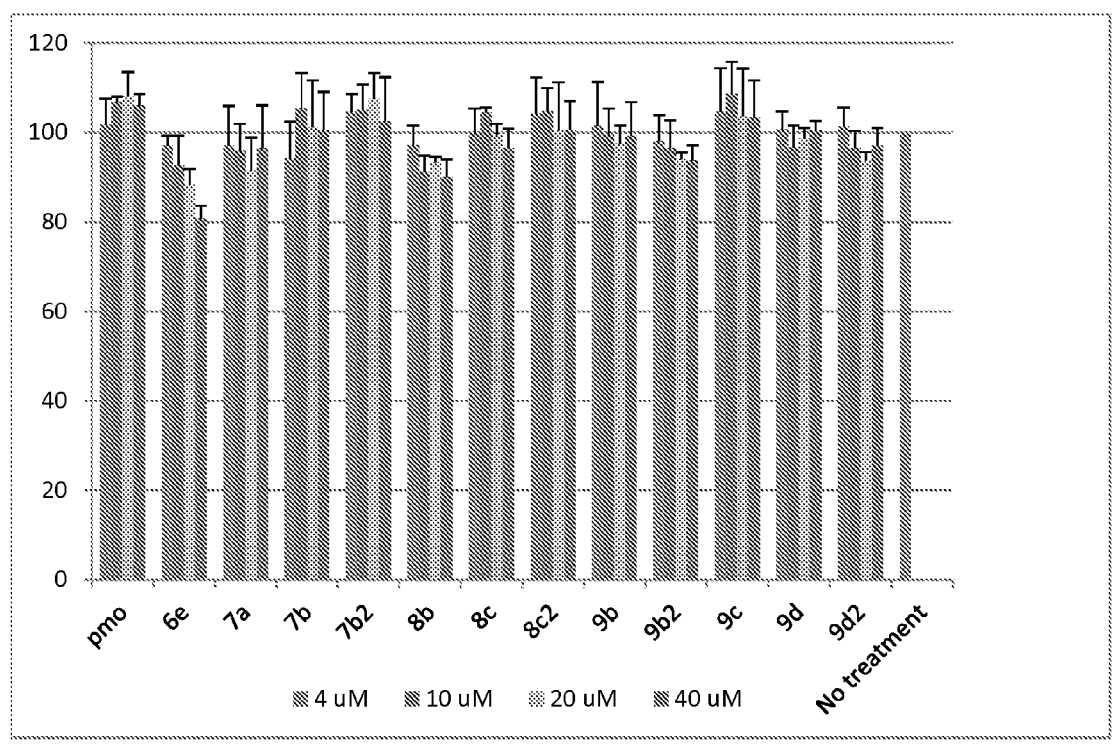
FIG. 42. Chart showing cell viability in Pip7, Pip8 and Pip9-PMO treated mdx myotubes.
Figure 43A:
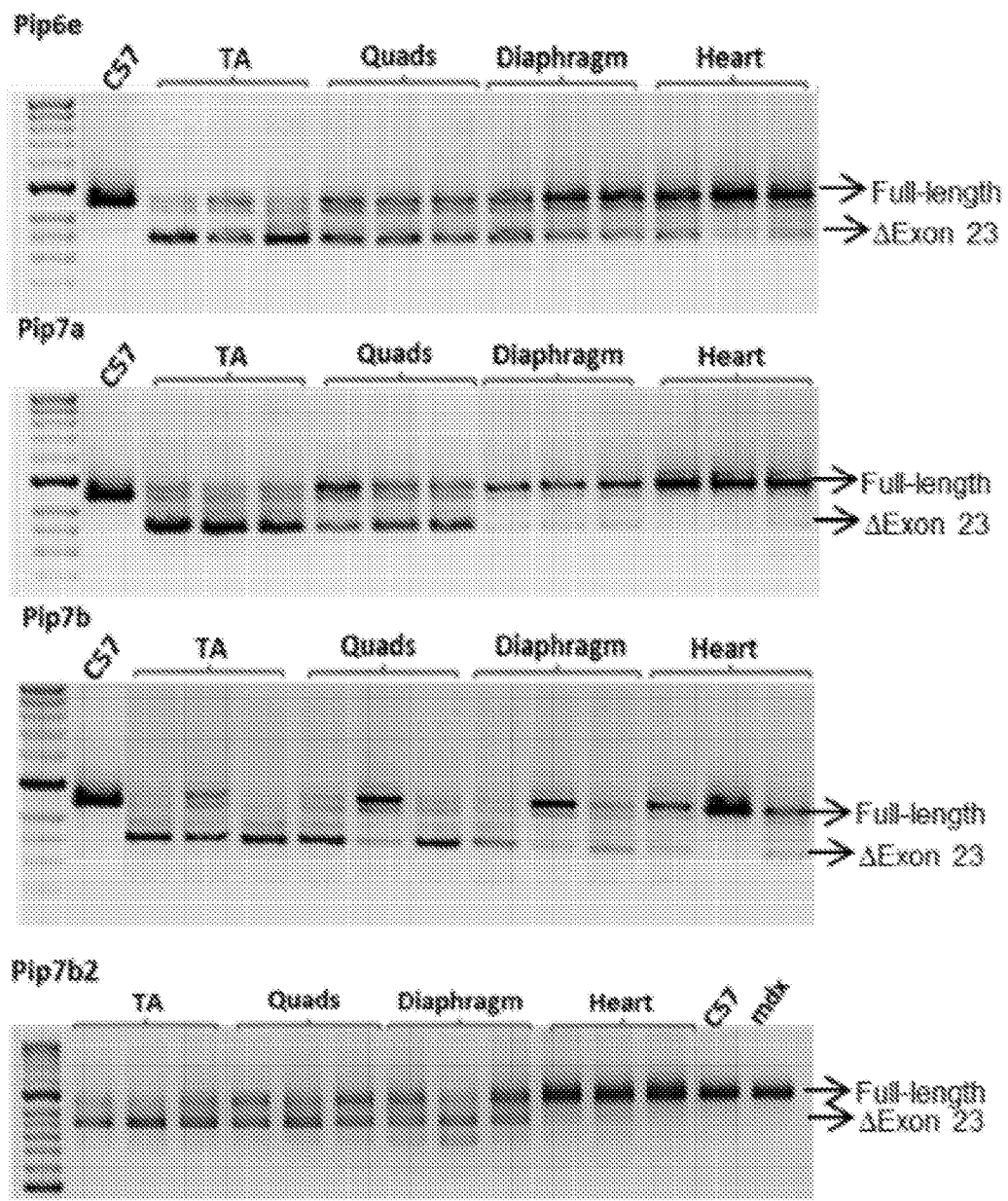
(FIG. 43a) Reverse transcriptase (RT)-PCR for detecting exon skipping efficiency at the RNA level, which is shown by shorter exon-skipped bands, (FIG. 43b) Western blot analysis of TA, quadriceps, diaphragm and heart muscles from mdx mice treated with Pip7-PMO conjugates. Total protein was extracted from four different muscles of treated mdx mice 2 weeks after injection. Ten micrograms of total protein from treated muscle samples was loaded. α-actinin was used as the loading control.
Figure 43B:
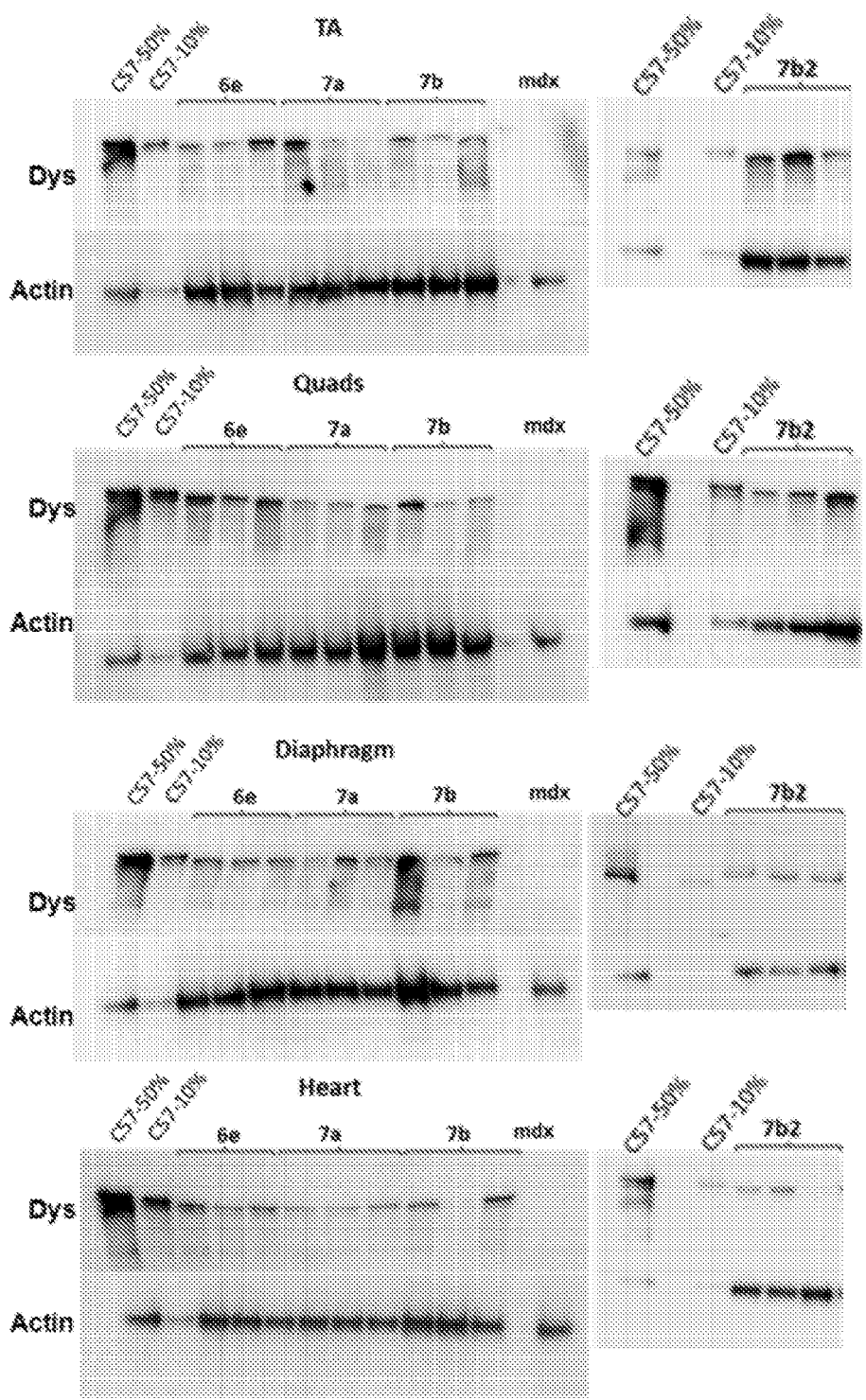
FIG. 43. Screen of Pip7-PMO conjugates following intravenous administration in mdx mice. Dystrophin expression following single intravenous injection at 12.5 mg/kg doses of Pip6e, Pip7a, Pip7b and Pip7b2 in 8 week old mdx mice.
Figure 44A:
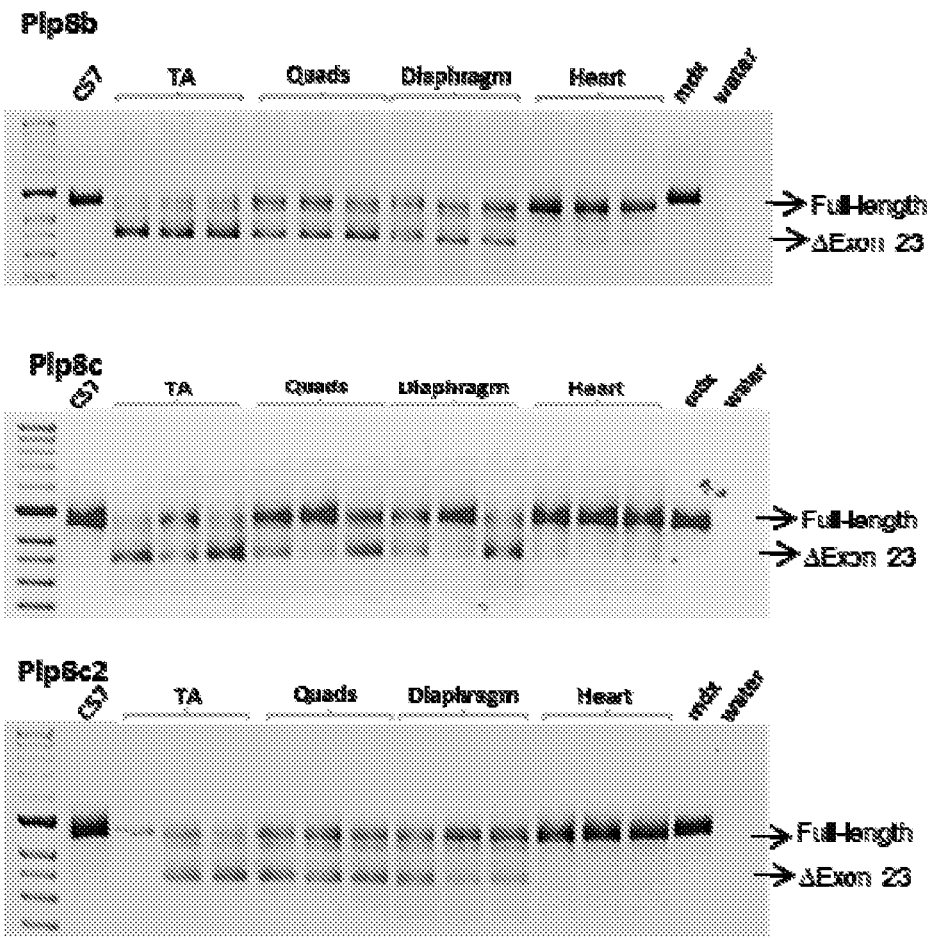
(FIG. 44a) Reverse transcriptase (RT)-PCR for detecting exon skipping efficiency at the RNA level, which is shown by shorter exon-skipped bands, (FIG. 44b) Western blot analysis of TA, quadriceps, diaphragm and heart muscles from mdx mice treated with Pip8-PMO conjugates. Total protein was extracted from four different muscles of treated mdx mice 2 weeks after injection. Ten micrograms of total protein from treated muscle samples was loaded. α-actinin was used as the loading control.
Figure 44B:
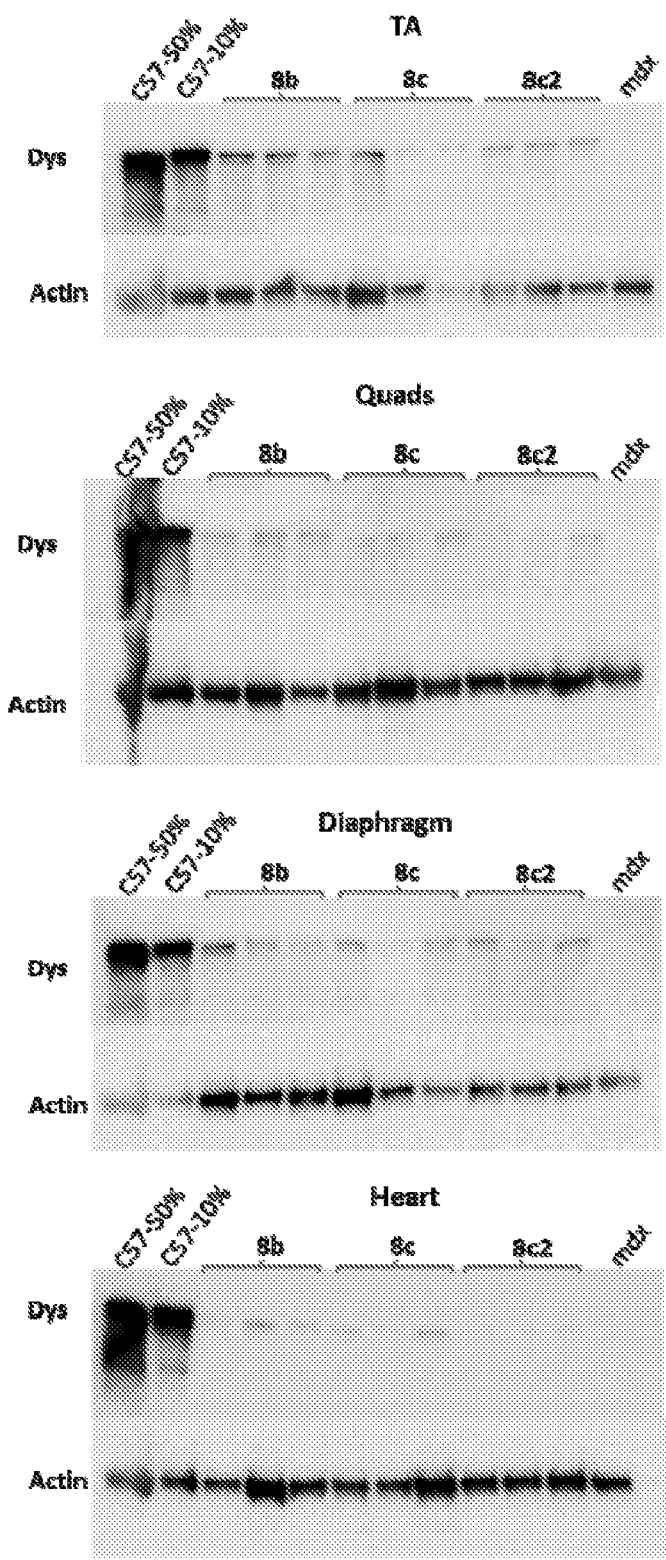
FIG. 44. Screen of Pip8-PMO conjugates following intravenous administration in mdx mice. Dystrophin expression following single intravenous injection at 12.5 mg/kg doses of Pip8b, Pip8c and Pip8c2 in 8 week old mdx mice.
Figure 45A:
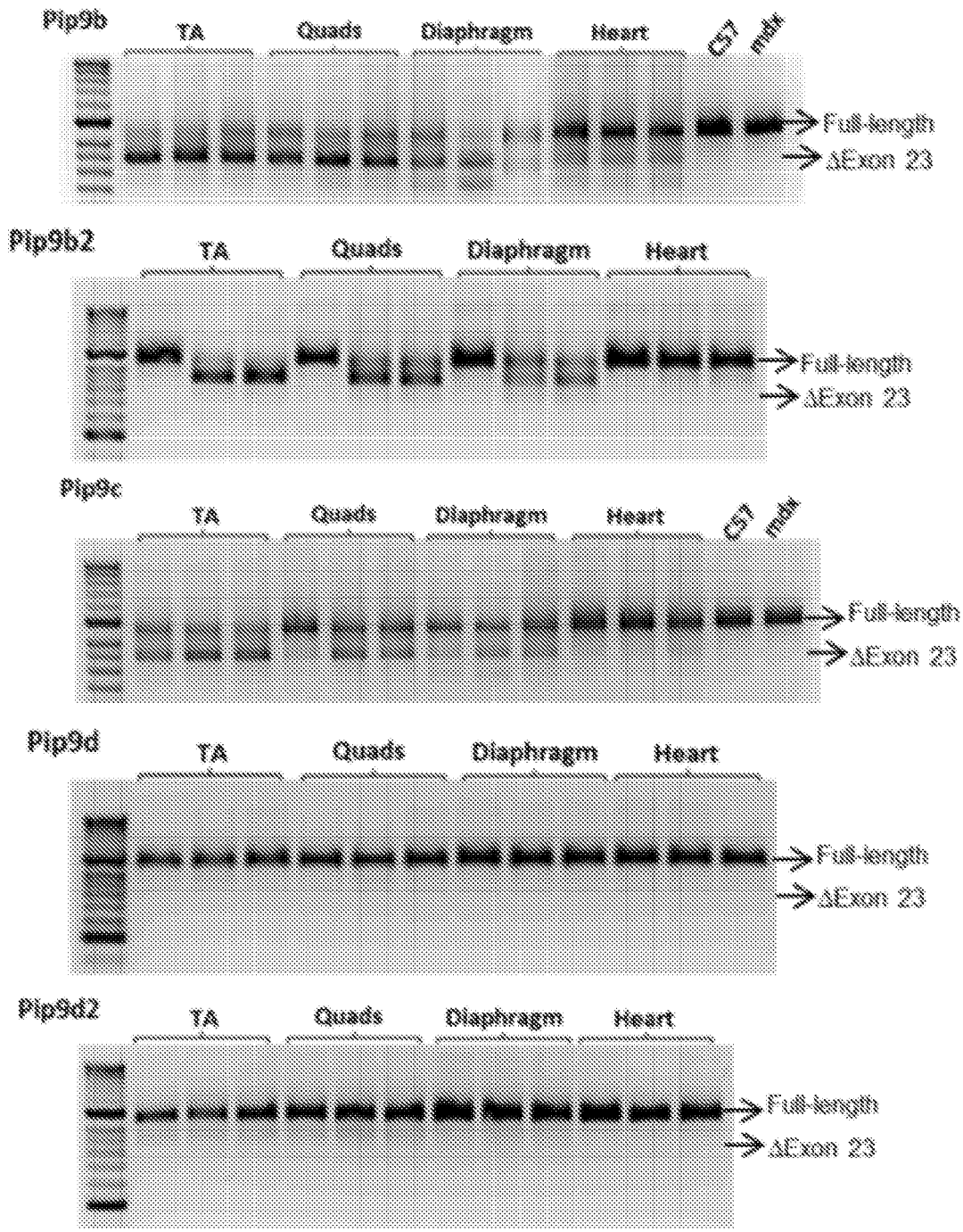
(FIG. 45a) Reverse transcriptase (RT)-PCR for detecting exon skipping efficiency at the RNA level, which is shown by shorter exon-skipped bands, (FIG. 45b) Western blot analysis of TA, quadriceps, diaphragm and heart muscles from mdx mice treated with Pip9-PMO conjugates. Total protein was extracted from four different muscles of treated mdx mice 2 weeks after injection. Ten micrograms of total protein from treated muscle samples was loaded. α-actinin was used as the loading control.
Figure 45B:
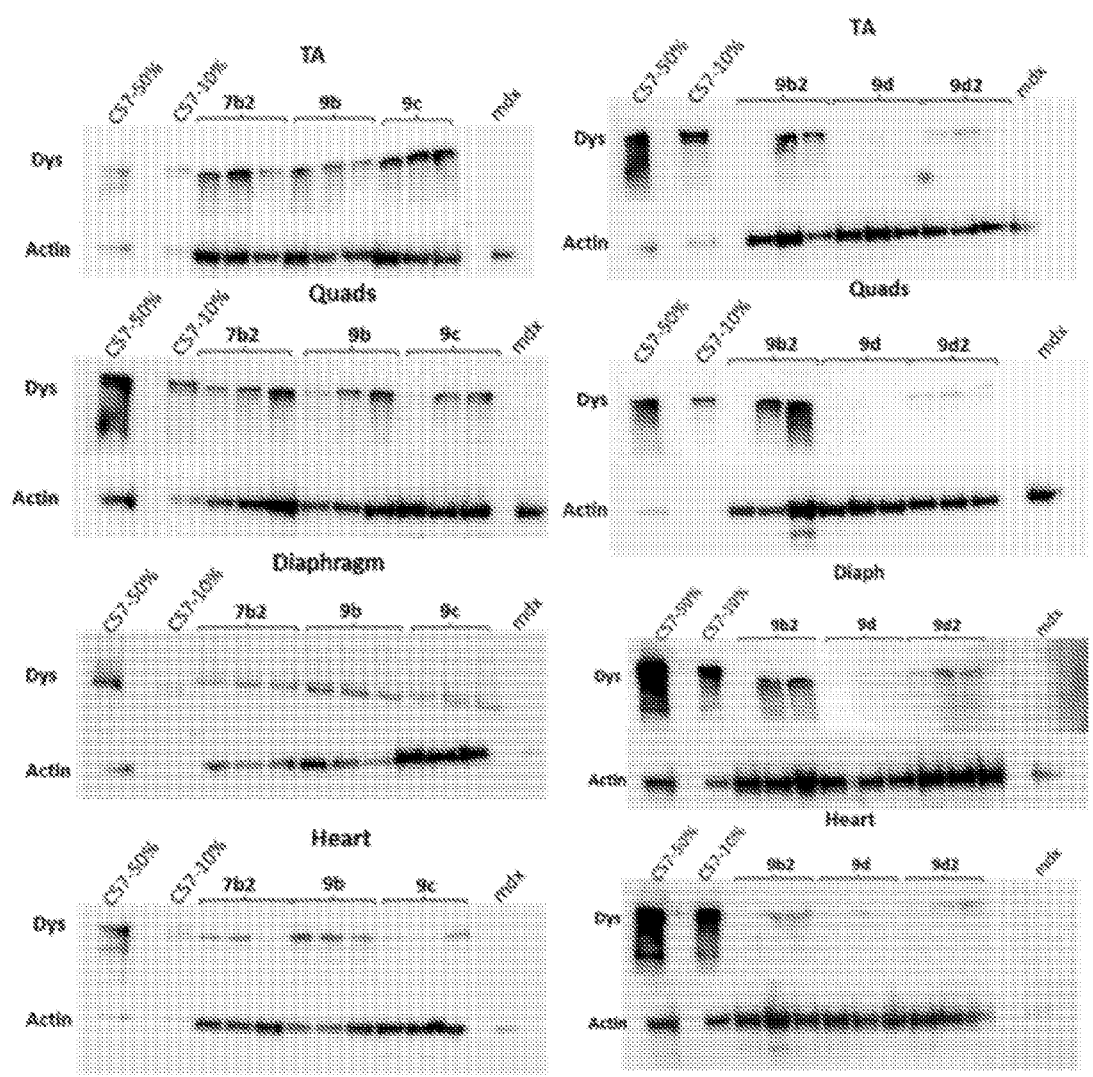
FIG. 45. Screen of Pip9-PMO conjugates following intravenous administration in mdx mice. Dystrophin expression following single intravenous injection at 12.5 mg/kg doses of Pip9b, Pip9b2, Pip9c, Pip9d and Pip9d2 in 8 week old mdx mice.

Toxicity studies of Pip7-9-PMO were undertaken using cell viability assays. These showed that 10 arginine-PMO conjugates (Pip6e) had a high level of cell toxicity (FIG. 42). Therefore, employing Pip 6a (Pip8 series), Pip6e (Pip7 series) and Pip6f (Pip9 series) as parent peptides, Pip7-9-PMO series were synthesised by reducing the number of arginine and aminohexanoyl (aminohexanoic acid) residues in order to minimise possible cell toxicity. Cell viability was substantially increased in Pip7-9-PMO treated mdx myotubes compared to Pip6e treated cells (FIG. 42), suggesting promise for subsequent in vivo studies.

Figure 2:
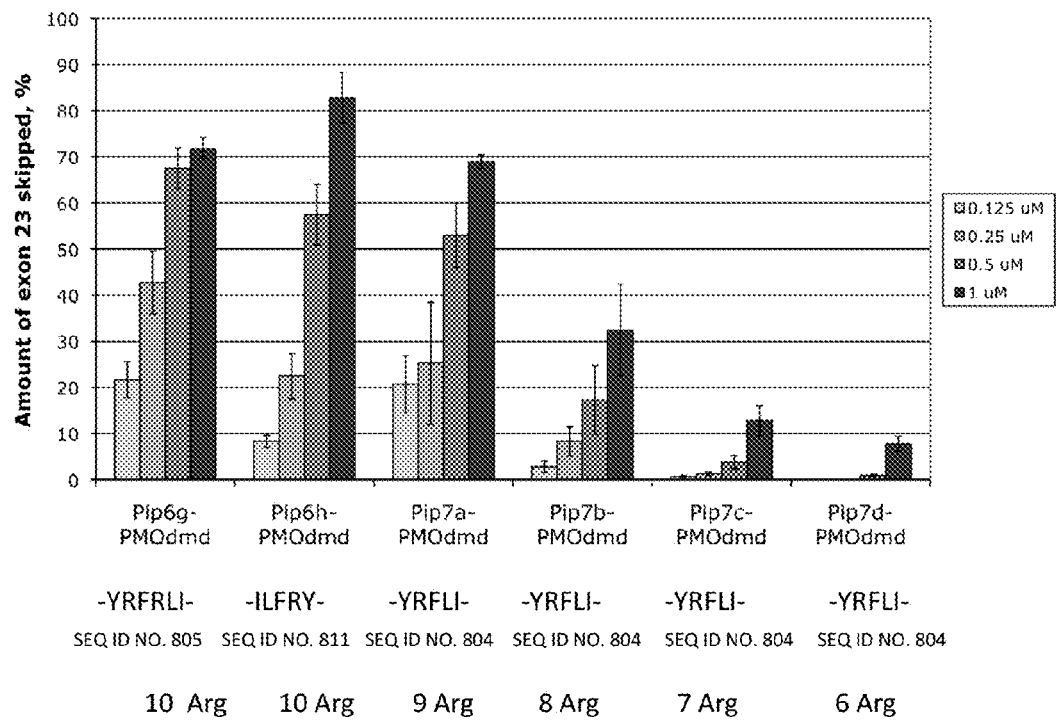
FIG. 2. Graph showing exon skipping activity of PMO-Peptides (Pip-6g, Pip-6h, Pip-7a, Pip-7b, Pip-7c, Pip-7d) in H2K mdx muscle myotubes.
Figure 3:
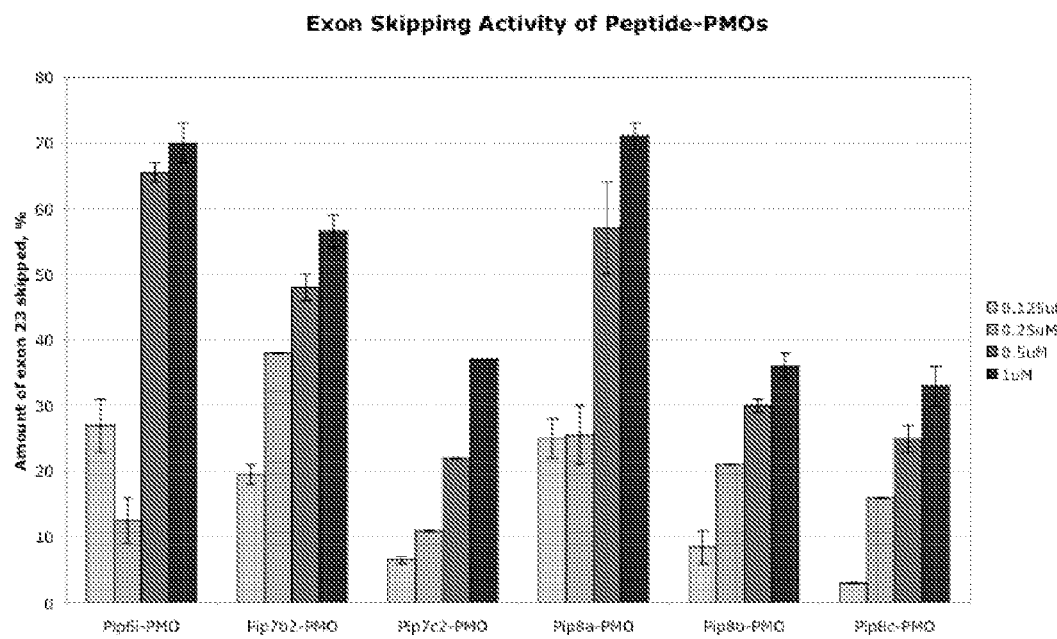
FIG. 3. Graph showing exon skipping activity of PMO-Peptides (Pip-6i, Pip-7b2, Pip-7c2, Pip-8a, Pip-8b, Pip-8c) in H2K mdx muscle myotubes.
Figure 4:
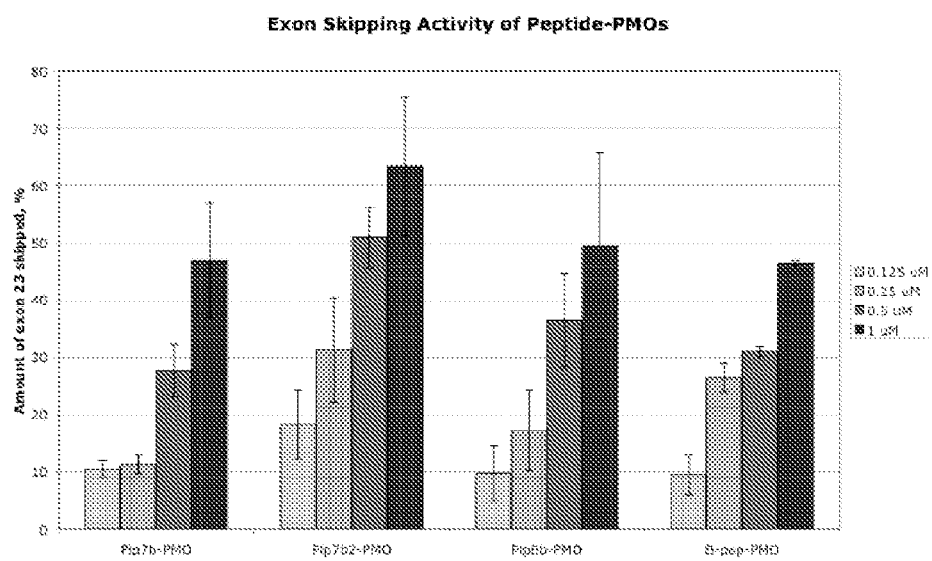
FIG. 4. Graph showing exon skipping activity of PMO-Peptides (Pip-7b, Pip-7b2, Pip-8b (each having 8 Arg), B peptide (RXRRBR)$_2$XB)) in H2K mdx muscle myotubes.
Figure 5:
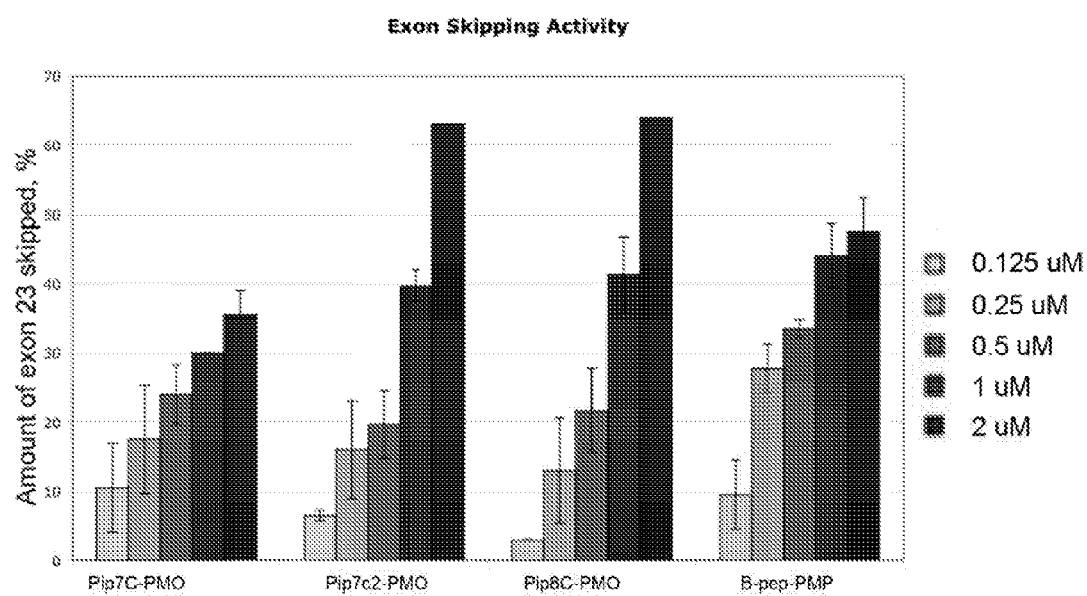
FIG. 5. Graph showing exon skipping activity of PMO-Peptides (Pip-7c, Pip-7c2, Pip-8c (each having 7 Arg), B peptide (RXRRBR)$_2$XB)) in H2K mdx muscle myotubes.
Figure 6:
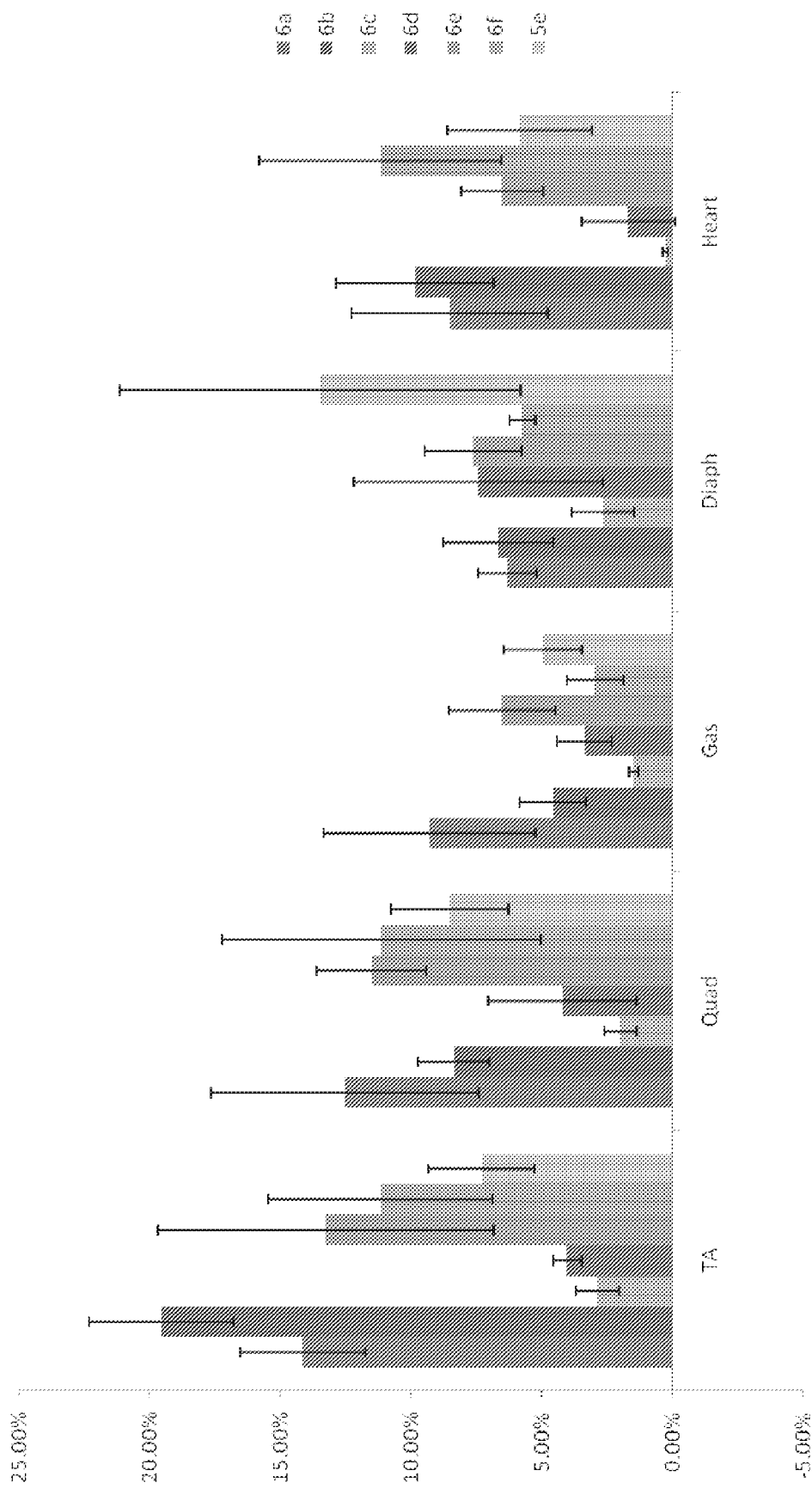
FIG. 6. Graph showing results of Western blot protein quantification of PMO-Peptides (Pip-6a, Pip-6b, Pip-6c, Pip-6d, Pip-6e, Pip-6f, Pip-5e) in different mouse muscle tissue in mdx mice (TA=tibialis anterior, Quad=quadriceps, Gas=gastrocnemius, diaph=diaphragm muscles, heart=cardiac muscle).
Figure 7A:
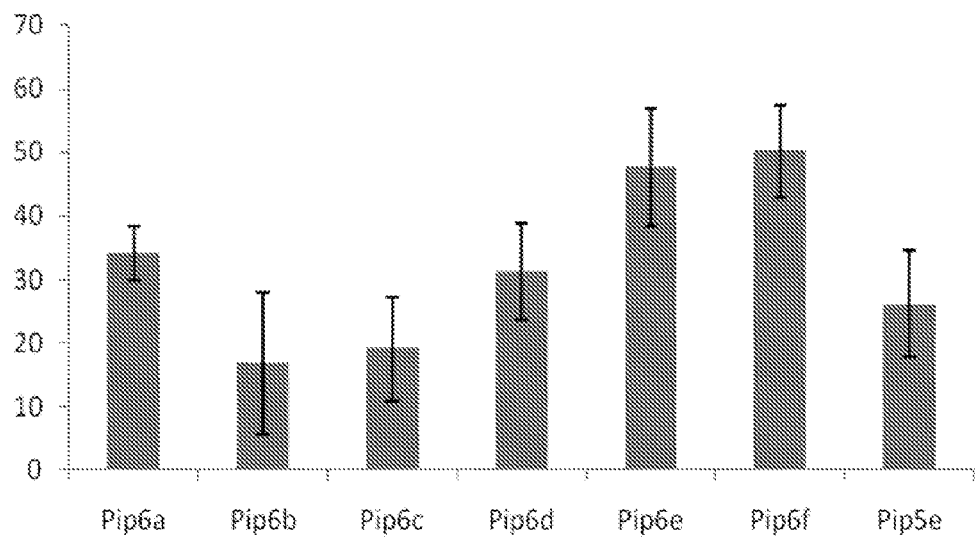
FIG. 7. Graphs showing qPCR results of exon skipping activity in (FIG. 7A) quadriceps, (FIG. 7B) diaphragm and (FIG. 7C) heart tissue from mdx mice for Pip-6a, Pip-6b, Pip-6c, Pip-6d, Pip-6e, Pip-6f and Pip-5e.
Figure 7B:
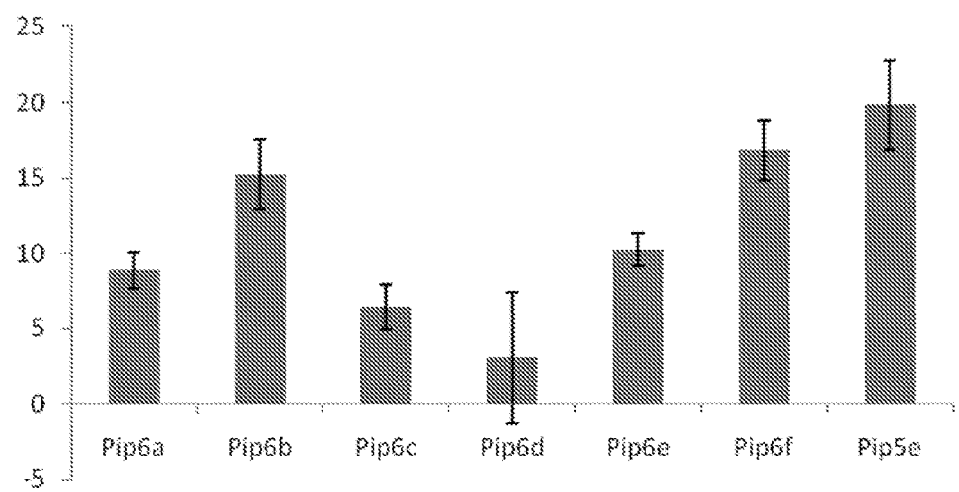
Figure 7C:
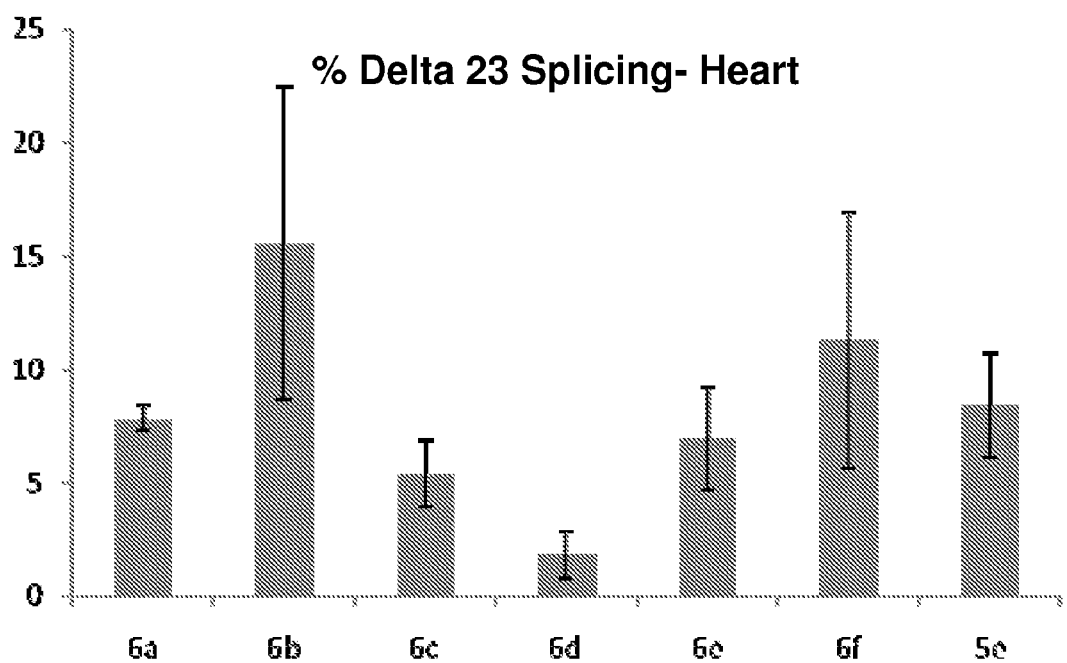
Figure 8A:
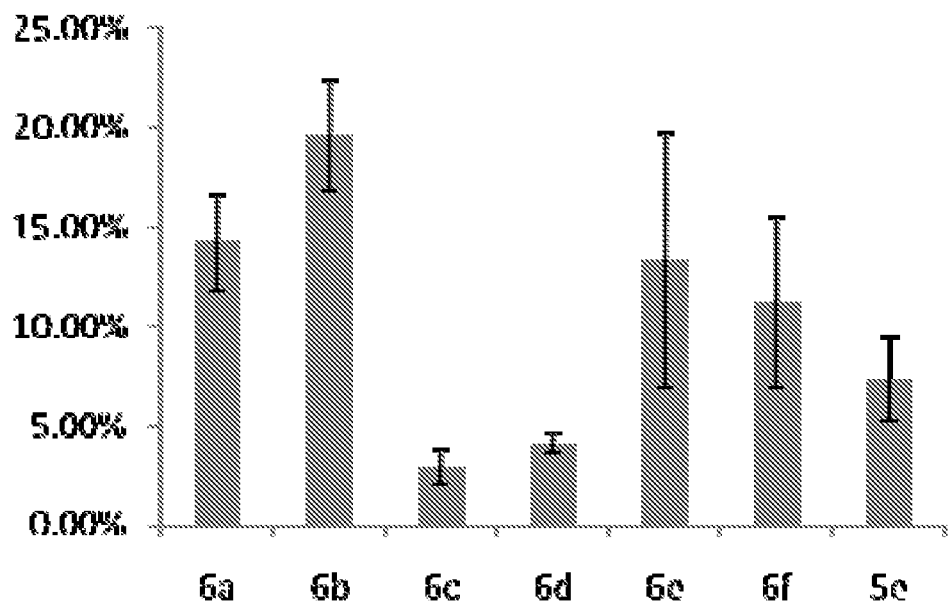
FIG. 8. Graphs showing quantitative Western blot results of exon skipping activity in (FIG. 8A) tibialis anterior, (FIG. 8B) quadriceps, (FIG. 8C) diaphragm and (FIG. 8D) heart tissue from mdx mice for Pip-6a, Pip-6b, Pip-6c, Pip-6d, Pip-6e, Pip-6f and Pip-5e.
Figure 8B:
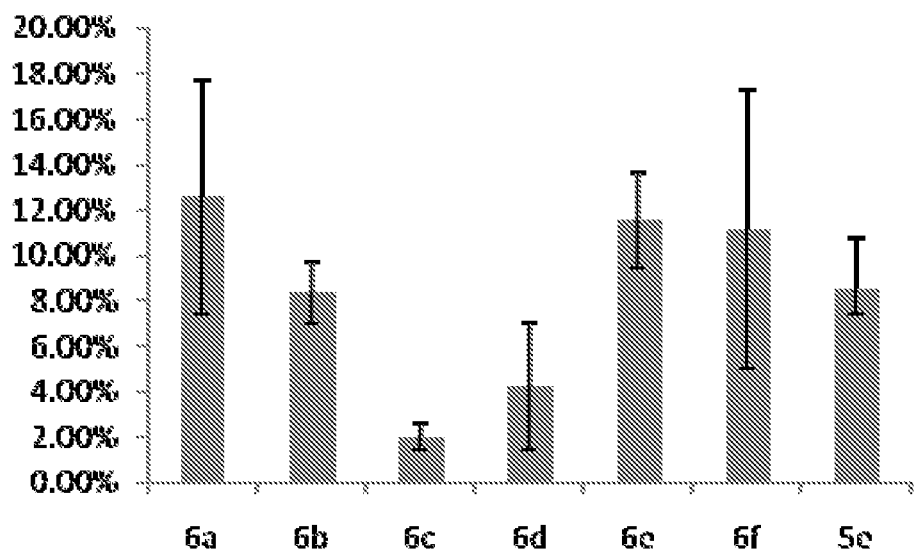
Figure 8C:
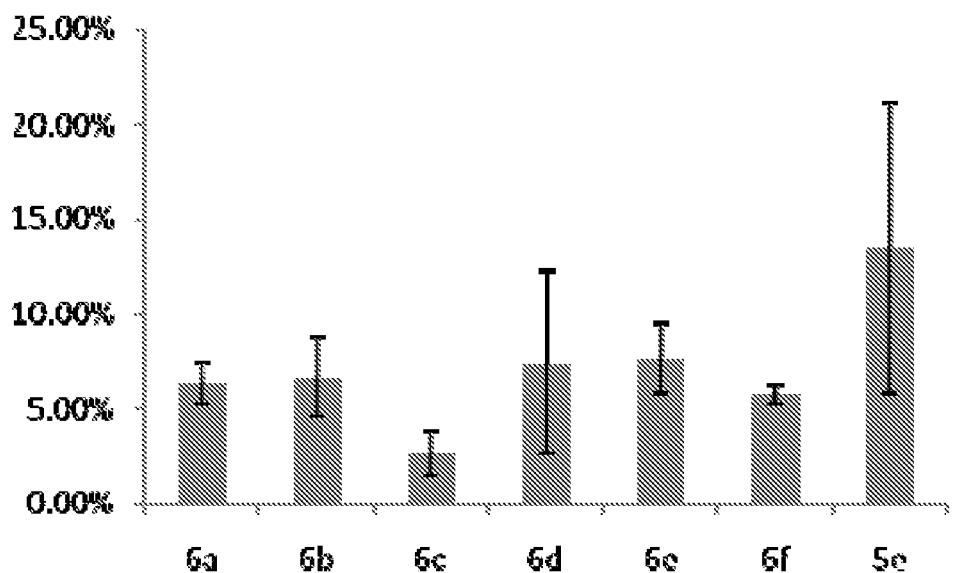
Figure 8D:
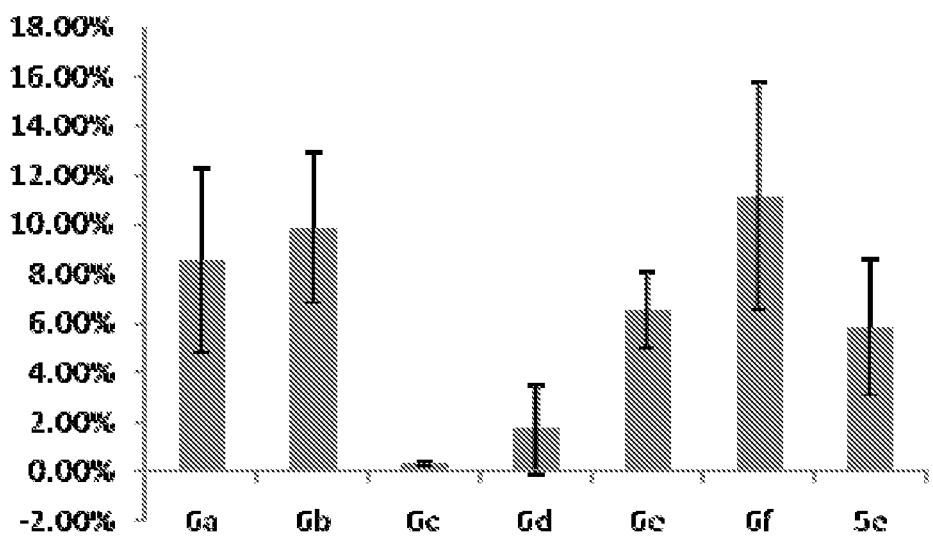
Figure 9:
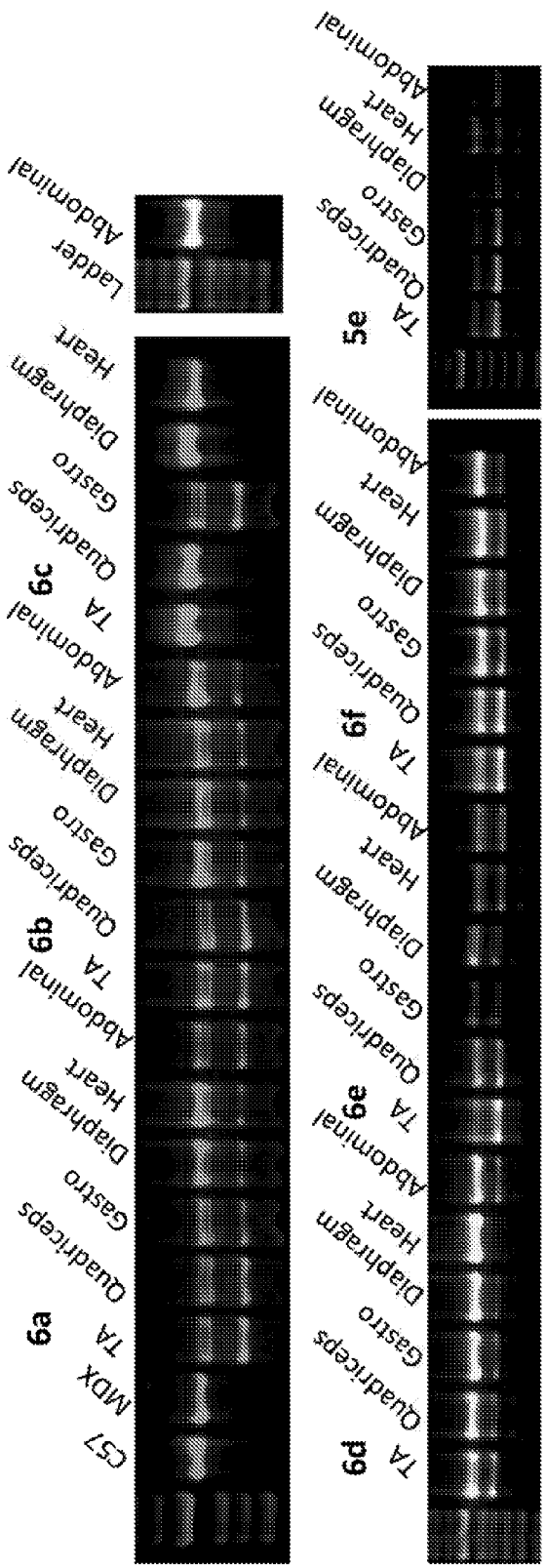
FIG. 9. Representative results of RT-PCR showing exon skipping activity in different muscle tissues of mdx mice for PMO-Peptides Pip-6a, Pip-6b, Pip-6c, Pip-6d, Pip-6e, Pip-6f and Pip-5e.
Figure 10:
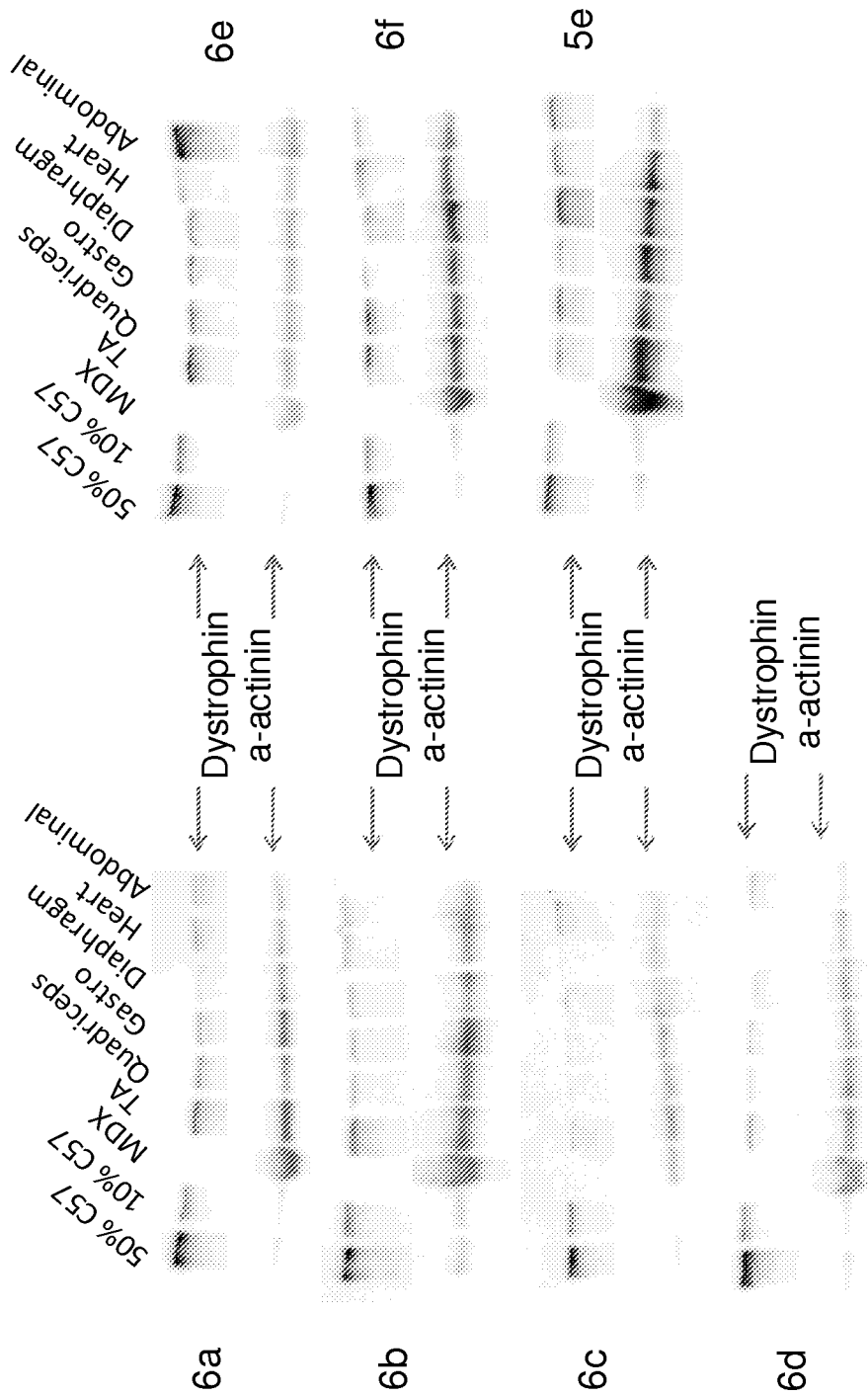
FIG. 10. Representative Western blots showing exon skipping activity in different muscle tissues of mdx mice for PMO-Peptides Pip-6a, Pip-6b, Pip-6c, Pip-6d, Pip-6e, Pip-6f and Pip-5e.
Figure 12A:
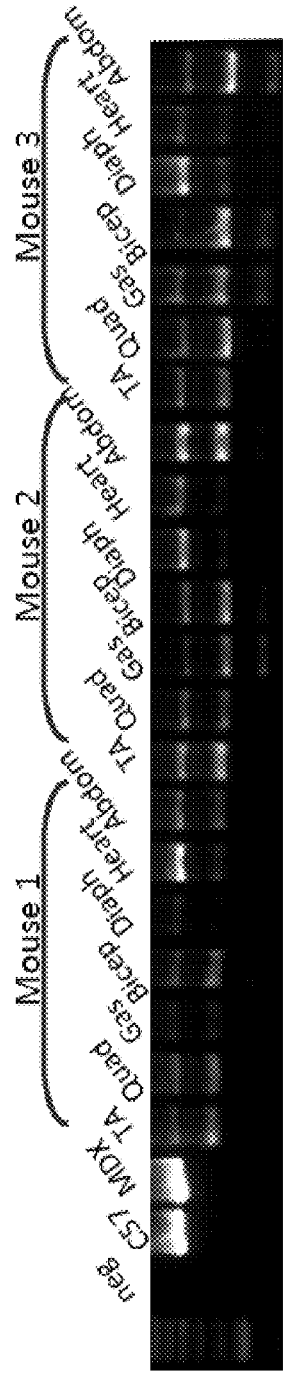
(FIG. 12A) RT-PCR results, (FIG. 12B) Western blot, (FIG. 12C) Plot of quantified Western blot data.
Figure 12C:
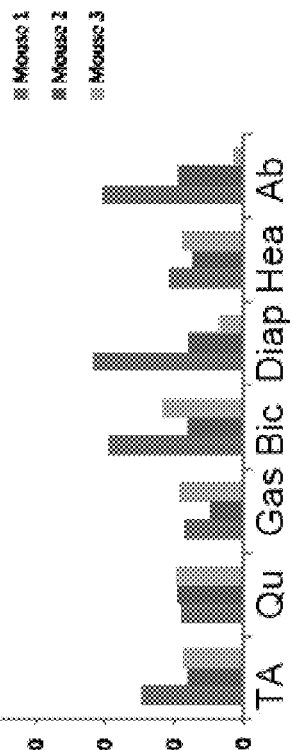
FIG. 12. Individual data set showing exon skipping activity in muscle tissue of mdx mice for Pip-6a-PMO.
Figure 12B:
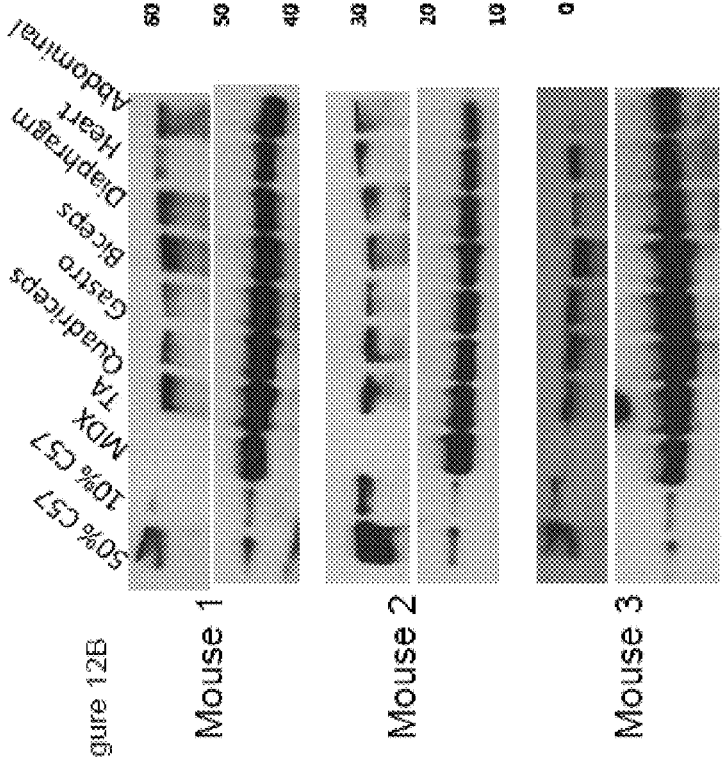
Figure 13A:
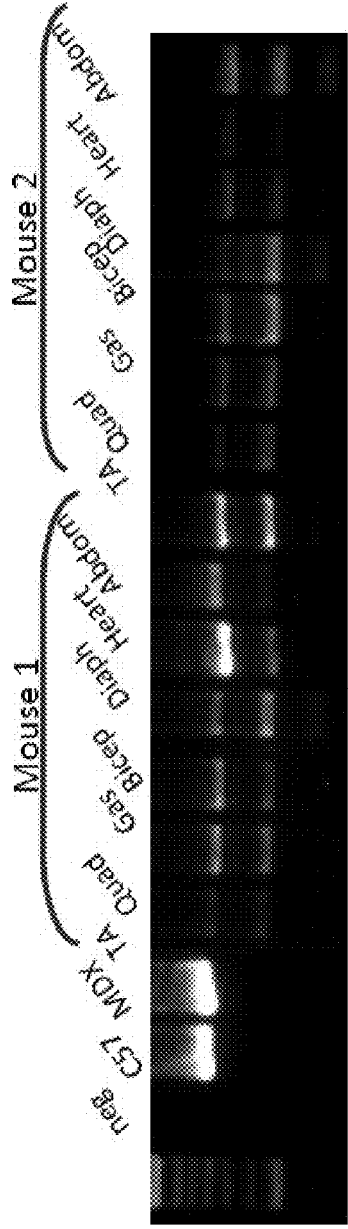
(FIG. 13A) RT-PCR results, (FIG. 13B) Western blot, (FIG. 13C) Plot of quantified Western blot data.
Figure 13C:
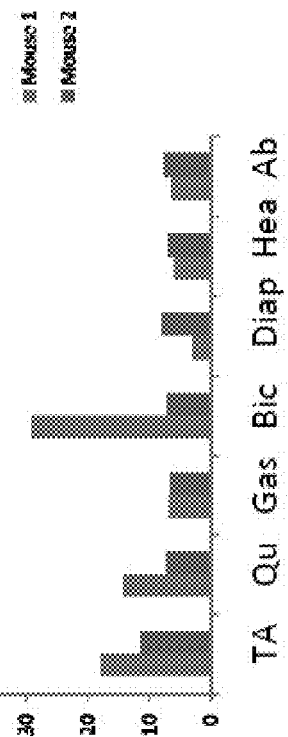
FIG. 13. Individual data set showing exon skipping activity in muscle tissue of mdx mice for Pip-6b-PMO.
Figure 13B:
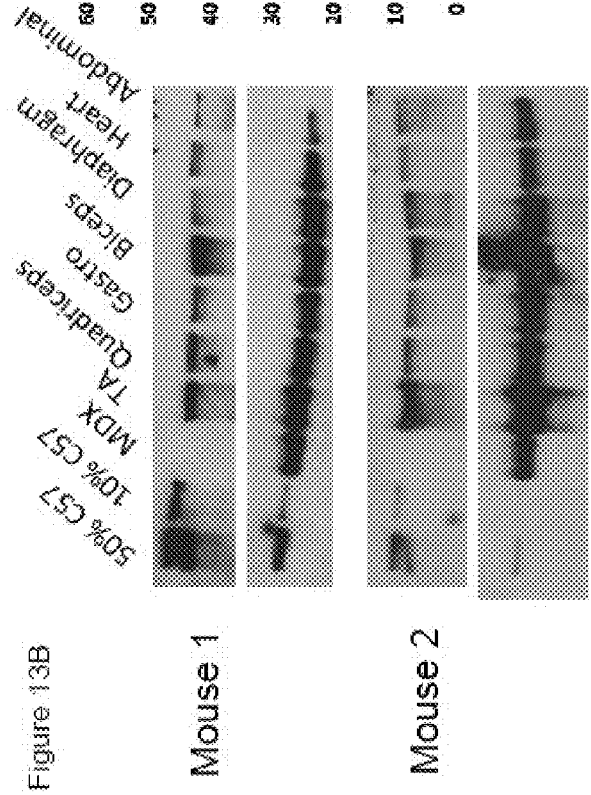
Figure 14A:
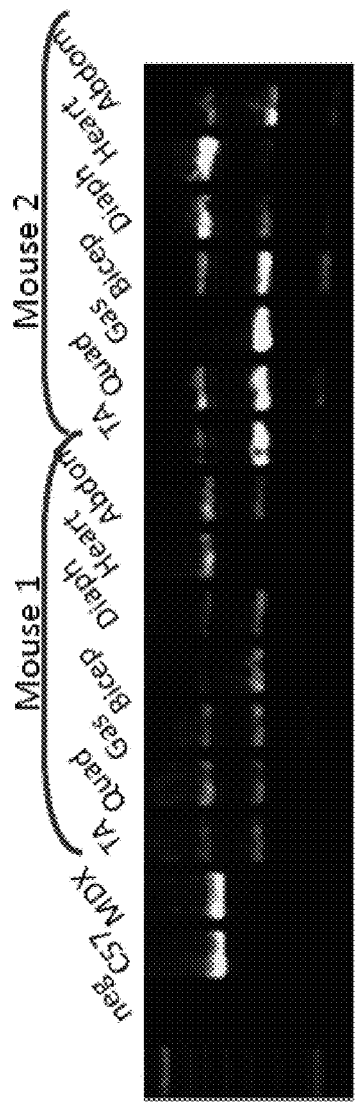
(FIG. 14A) RT-PCR results, (FIG. 14B) Western blot, (FIG. 14C) Plot of quantified Western blot data.
Figure 14C:
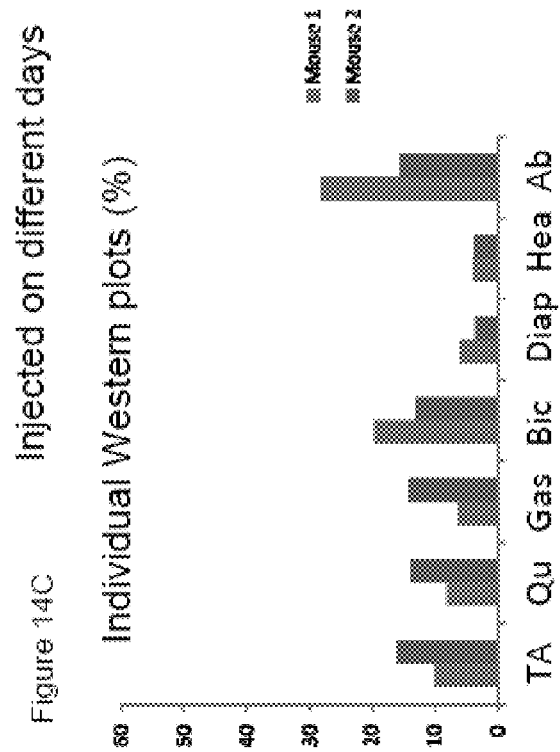
FIG. 14. Individual data set showing exon skipping activity in muscle tissue of mdx mice for Pip-6c-PMO.
Figure 14B:
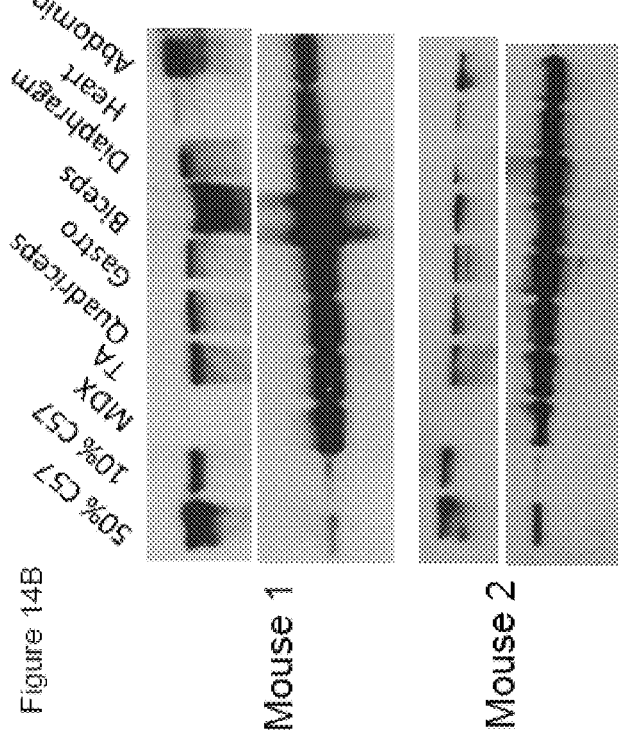
Figure 15A:
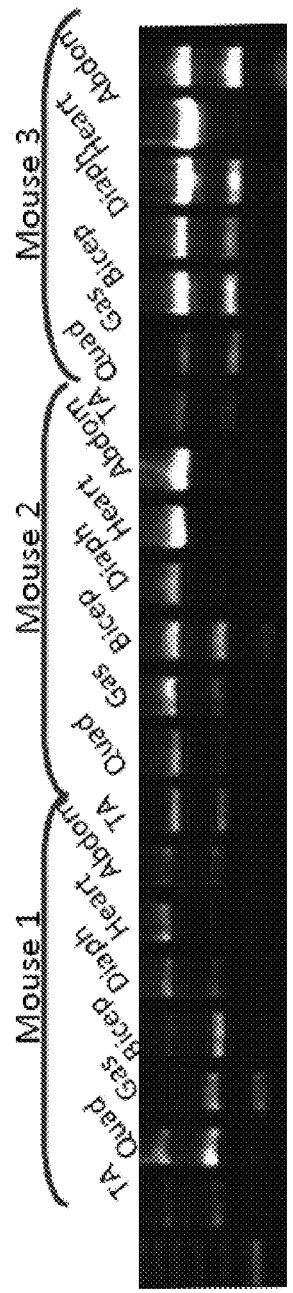
(FIG. 15A) RT-PCR results, (FIG. 15B) Western blot, (FIG. 15C) Plot of quantified Western blot data.
Figure 15C:
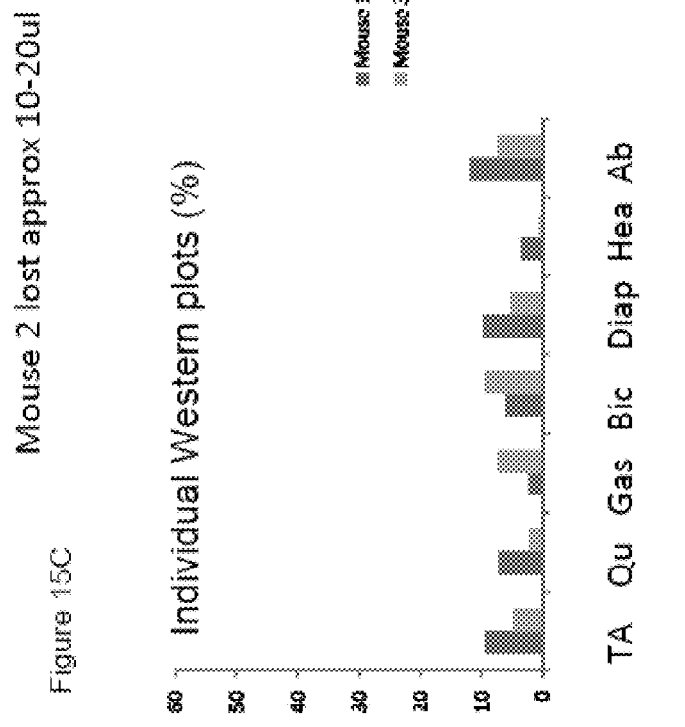
FIG. 15. Individual data set showing exon skipping activity in muscle tissue of mdx mice for Pip-6d-PMO.
Figure 15B:
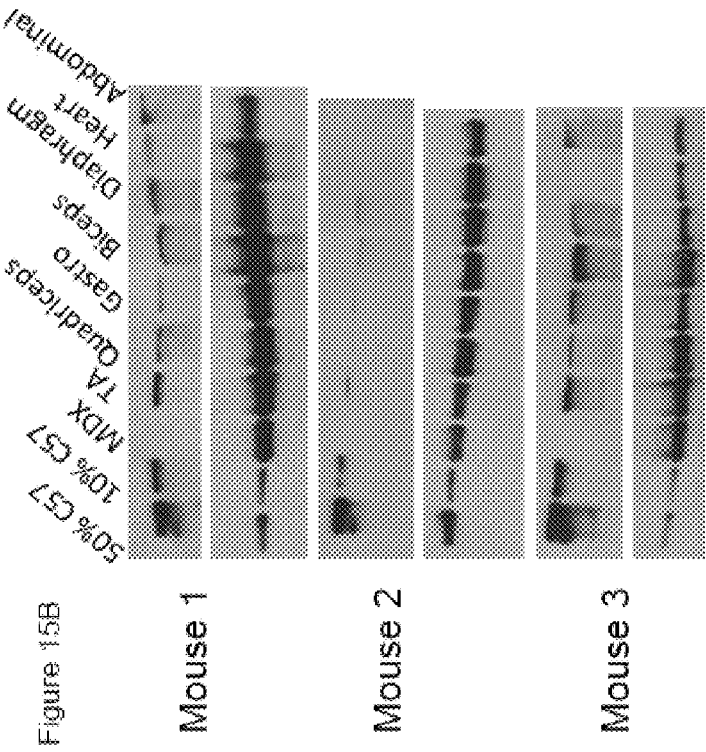
Figure 16A:
(FIG. 16A) RT-PCR results, (FIG. 16B) Western blot, (FIG. 16C) Plot of quantified Western blot data.
Figure 16B:
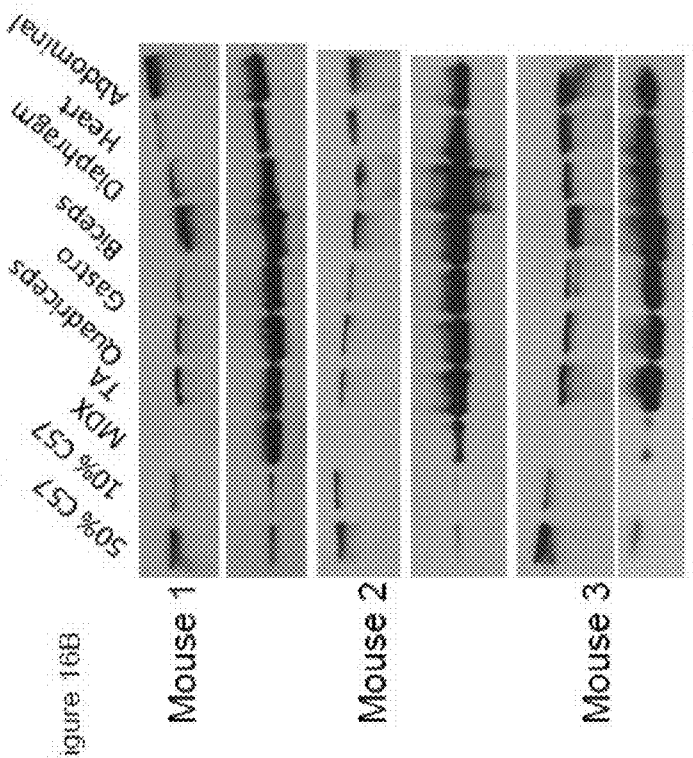
FIG. 16. Individual data set showing exon skipping activity in muscle tissue of mdx mice for Pip-6e-PMO.
Figure 16C:
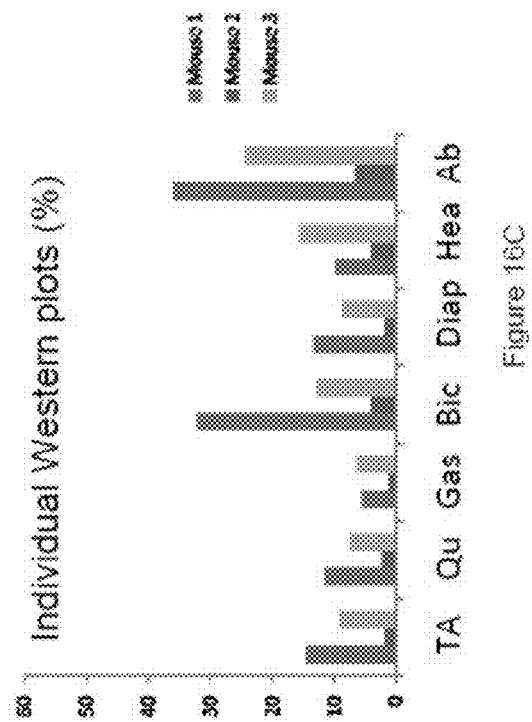
Figure 19:
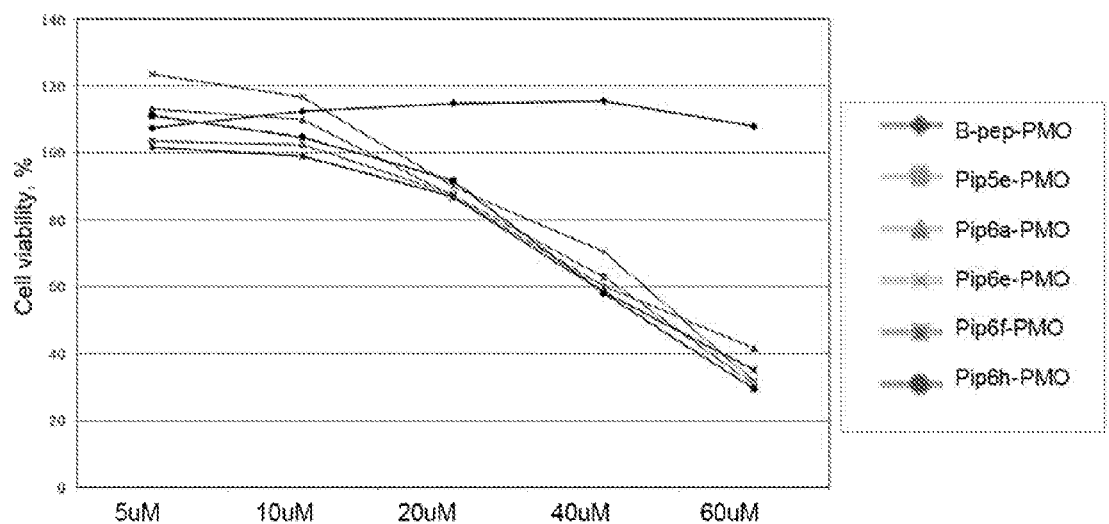
FIG. 19. Graph showing cell viability of B-peptide-PMO, Pip-5e-PMO, Pip-6a-PMO, Pip-6c-PMO, Pip-6f-PMO, Pip-6h-PMO as a function of concentration of added Pip-PMO.
Figure 20:
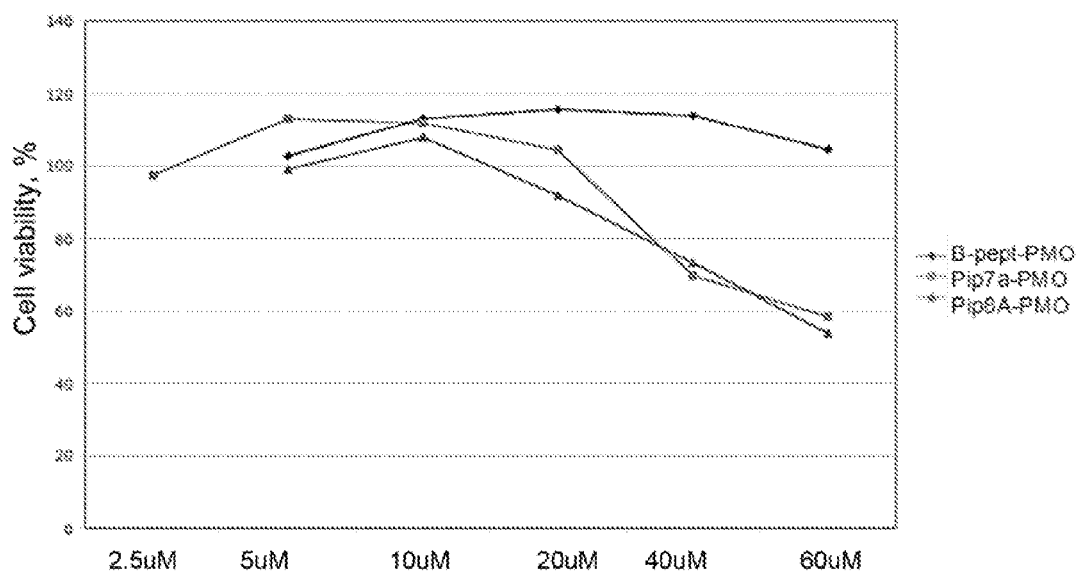
FIG. 20. Graph showing cell viability of B-peptide-PMO, Pip-7a-PMO, Pip-8a-PMO (containing 9 Arg residues) as a function of concentration of added Pip-PMO.
Figure 21:
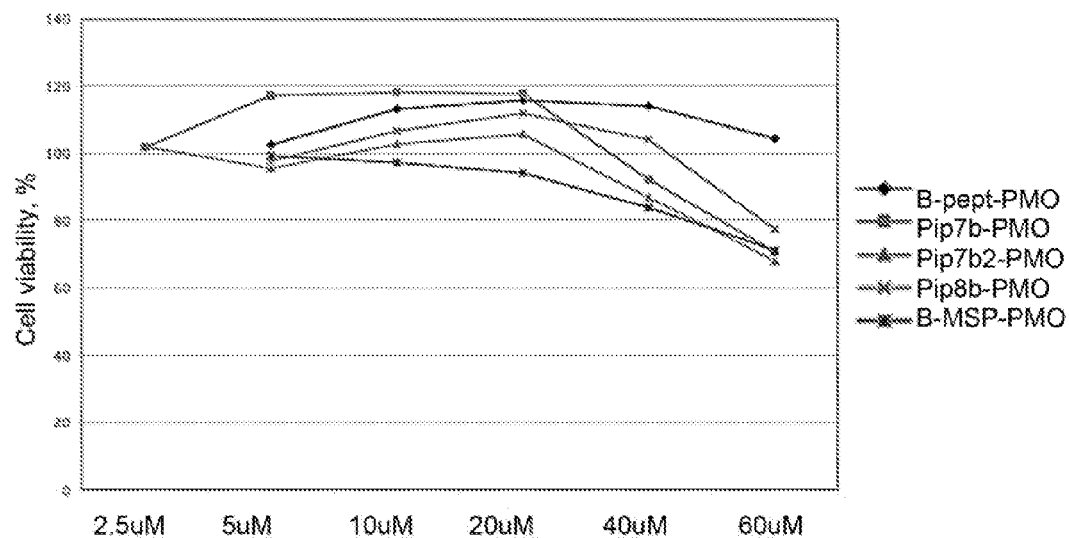
FIG. 21. Graph showing cell viability of B-peptide-PMO, Pip-7b-PMO, Pip-7b2-PMO, Pip-8b-PMO (containing 8 Arg residues) and B-MSP-PMO (RXRRBRRXRRBRASSLNIAX [SEQ ID NO:810], Yin, H. et al, (2010) Mol. Ther. 18, 1822-1827) as a function of concentration of add Pip-PMO.
Figure 22:
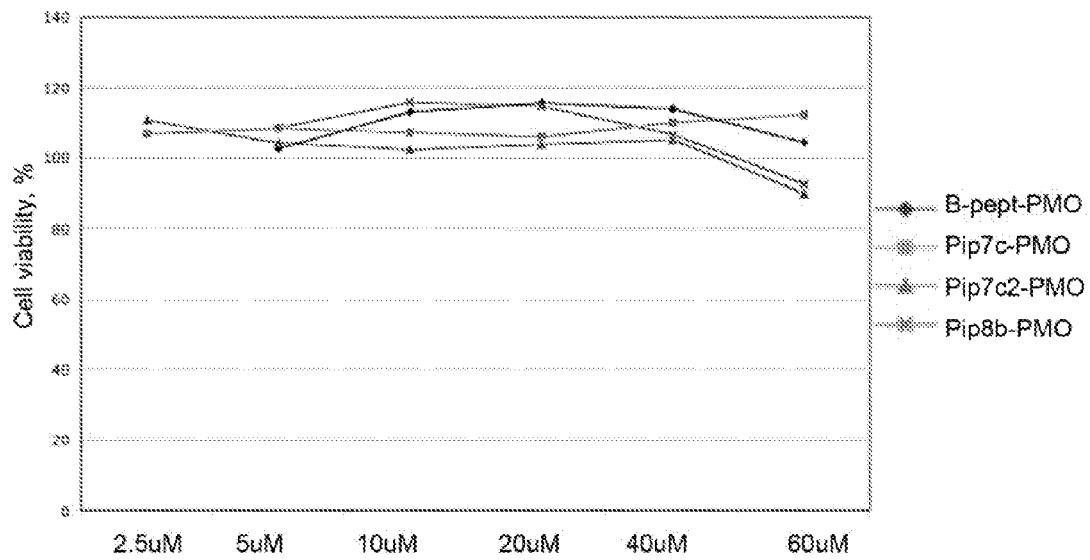
FIG. 22. Graph showing cell viability of B-peptide-PMO, Pip-7c-PMO, Pip-7c2-PMO, Pip-8c-PMO (containing 7 Arg residues) as a function of concentration of added Pip-PMO.
Figure 46A:
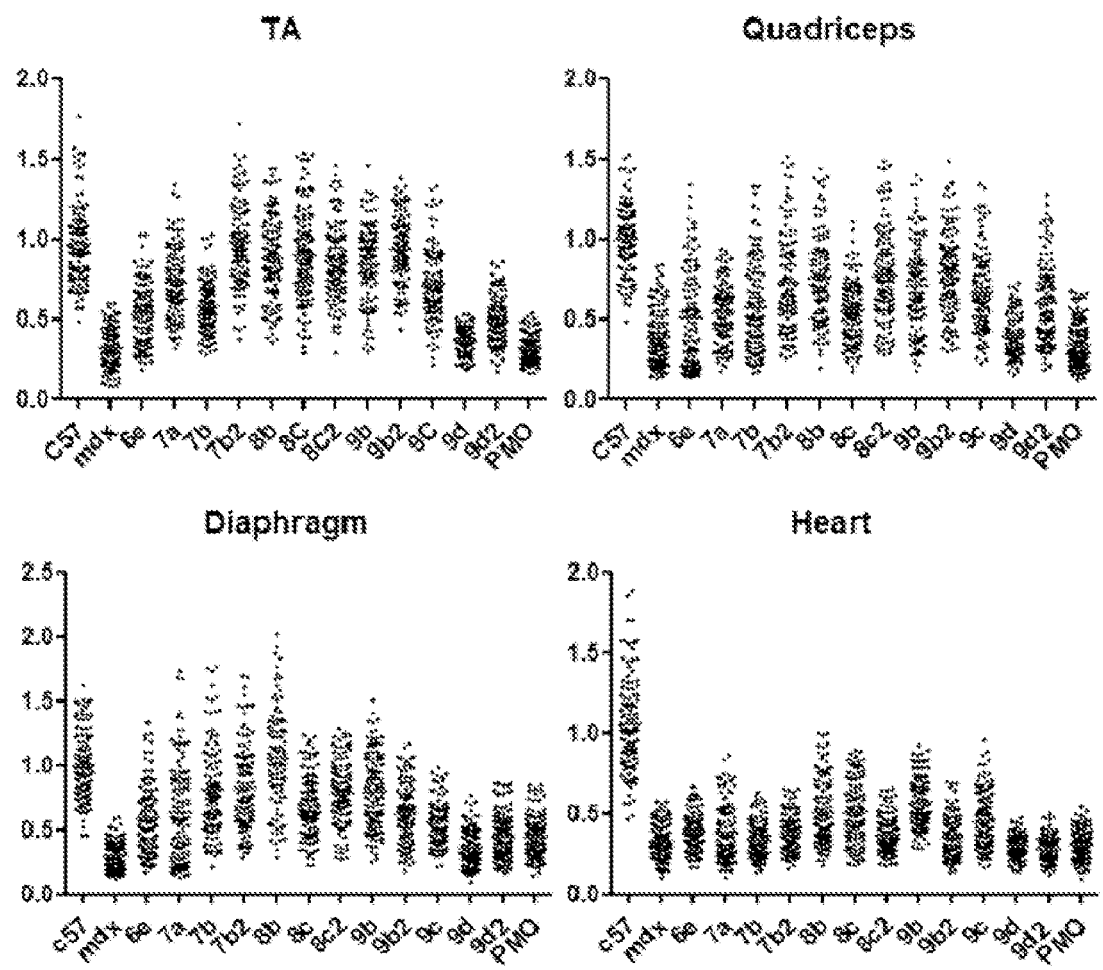
(FIG. 46a) The intensity of dystrophin immune-stained fibres using dystrophin antibody were analysed by Image Pro software as previously reported (Arechavala-Gomeza et al., 2010) using a rat anti-laminin for normalisation and expressed as a percentage of the intensity level of C57BL/10 muscles. Relative intensity values for each region of interest (120 regions) are plotted and the mean intensity calculated (represented by the red bar) (FIG. 46b). The dystrophin staining intensity was normalised to an average of C57BL/10 (100%) and mdx (0%) muscles. The recovery score for each animal (n=3) is plotted and the mean recovery score calculated (represented by the red bar). (mean—SEM; n=3; One way-ANOVA test: ns, not significant, * p<0.05, <0.001, *<0.0001 compared to mdx and C57 controls).
Figure 46B:
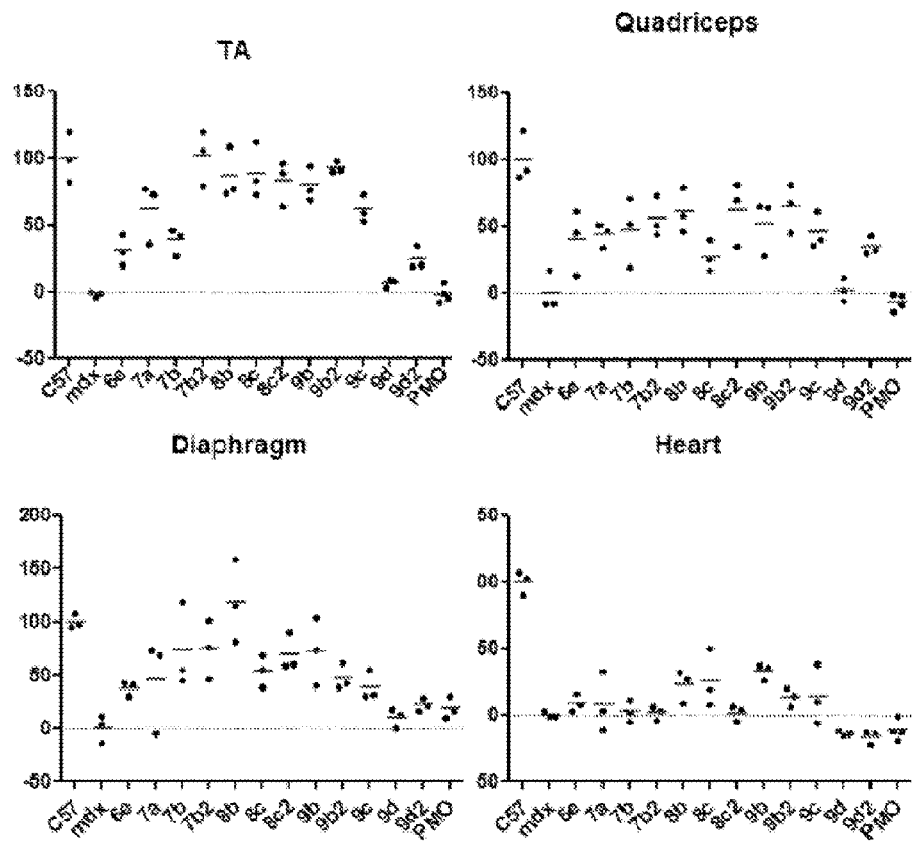
FIG. 46. Semiquantitative analysis of dystrophin restoration following intravenous injection with Pip7-9-PMO. TA, quadriceps, diaphragm and heart muscles were immunostained and analysed using ImagePro to show and quantify dystrophin expression.

A Single Intravenous Injection of Pip7-9-PMO Results in Widespread Dystrophin Expression in the mdx Skeletal/Peripheral Muscles To evaluate the exon skipping efficiency of Pip7-9-PMO compounds, 8 week old mdx mice were intravenously injected with 12.5 mg/kg of Pip7-9-PMO. At 2 weeks after injection, dystrophin expression was analysed in the tibialis anterior (TA), diaphragm, quadriceps and heart muscles. We evaluated the immune-stained dystrophin positive fibres, exon skipped mRNA and dystrophin protein levels (FIGS. 2-4). The intensity of dystrophin immuno-stained fibres was analysed using a rat anti-laminin antibody for normalisation and this was expressed as a ratio of the intensity level of C57BL/10 muscles (FIG. 5). Remarkable expression of exon-skipped dystrophin positive myofibres was observed in all Pip7-9-PMO injected skeletal muscles such as TA, quadriceps and diaphragm muscles at 2 weeks after injection (FIGS. 43-46). However, only Pip8b, Pip8c, Pip9b, Pip9b2 and Pip9c rendered significant dystrophin expression in the heart (FIG. 46). Pip7a, Pip7b, Pip7b2, Pip8c2, Pip9d and Pip9d2 resulted in negligible dystrophin production in the heart (FIG. 46). Taking into account the structures of the peptides, it is apparent that the order of the amino acids in the hydrophobic core region is less important, as even the scrambled hydrophobic core of the Pip9 series yielded similar dystrophin expression to the Pip8 series in the heart.

Toxicological Evaluation Following Systemic Administration of the Pip7-9-PMO

Figure 47A:
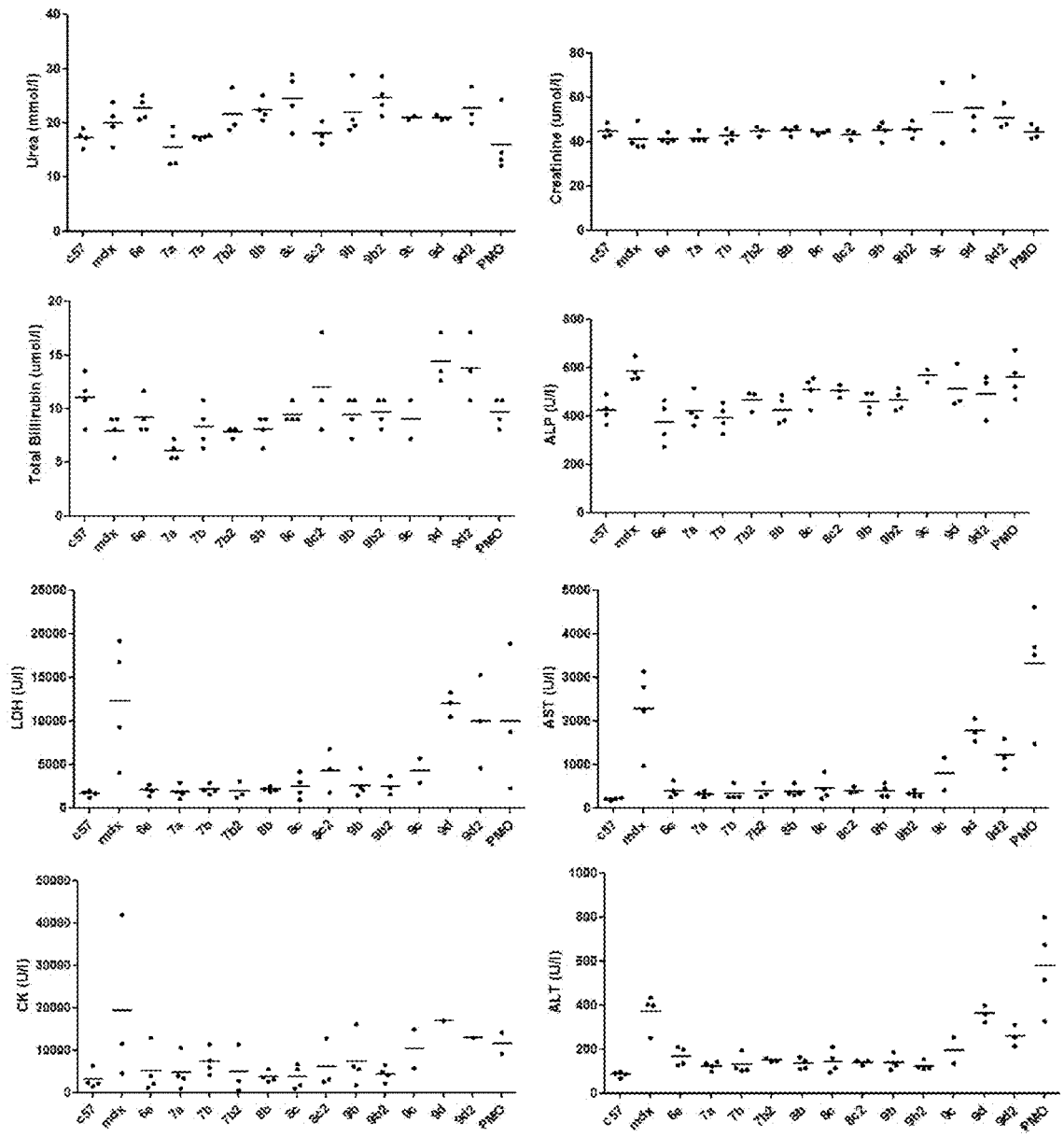
FIGS. 47A and B. Clinical biochemistry of serum markers of liver and renal function in mdx mice treated with Pip7-9-PMO conjugates at the 12.5 mg/kg dose. Serum was taken from the mouse jugular vein immediately after sacrificing at 2 weeks after injection by $CO_2$ inhalation. Analysis of serum creatine kinase, Creatinine, Urea, Alkaline Phosphatase (ALP), Alanine aminotransferase (ALT), Aspartate aminotransferase (AST), Total Bilirubin, Lactate Dehydrogenase (LDH) levels was carried out. (mean—SEM; n=3; Two tailed t-test: ns, not significant, * p<0.05, <0.001, *<0.0001 compared to either mdx or C57BL/10).

To evaluate the toxicity responses in Pip7-9-PMO treated mdx mice, we have undertaken preliminary evaluations of liver and renal function at 2 weeks after systemic administration of the Pip7-9-PMO compounds by extracting and analysing serum from treated mice and controls. Analysis of serum creatine kinase (CK), creatinine, urea, alkaline phosphatase (ALP), alanine aminotransferase (ALT), aspartate aminotransferase (AST), total bilirubin, lactate dehydrogenase (LDH) levels was carried out. There was no elevation in the level of urea and creatinine, a marker for kidney toxicity and TBIL, a marker for liver toxicity in PPMO treated mdx serum compared to untreated mdx control (FIG. 47). The ALT, AST, ALP and LDH levels were elevated in untreated mdx mice. There was no elevation in the levels of these markers in PPMO treated mdx serum compared to untreated mdx control. CK levels were variable between mice.

Further Identification of Lead PPMO (Exon23 Mouse) in mdx Mice

We have identified PPMO to give high level of dystrophin restoration in both skeletal and heart muscle in mdx mice. Pip8b, 9b, 9b2, 8c and 9c have shown significant promise with very efficient dystrophin restoration in the tibialis anterior (TA), diaphragm, quadriceps and heart, without apparent toxicity.

Figure 48A:
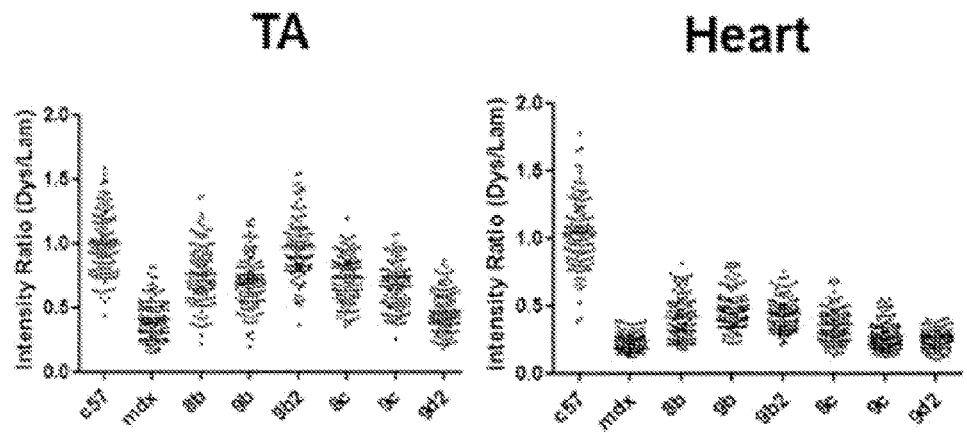
(FIG. 48a) Charts showing the intensity of dystrophin immune-stained fibres using dystrophin antibody analysed by Image Pro software as previously reported (Arechavala-Gomeza et al., 2010) using a rat anti-laminin for normalisation and expressed as a percentage of the intensity level of C57BL/10 muscles. Relative intensity values for each region of interest (120 regions) are plotted and the mean intensity calculated (represented by the red bar) (FIG. 48b) Charts showing the dystrophin staining intensity normalised to an average of C57BL/10 (100%) and mdx (0%) muscles. The recovery score for each animal (n=3) is plotted and the mean recovery score calculated (represented by the horizontal bars).
Figure 48B:
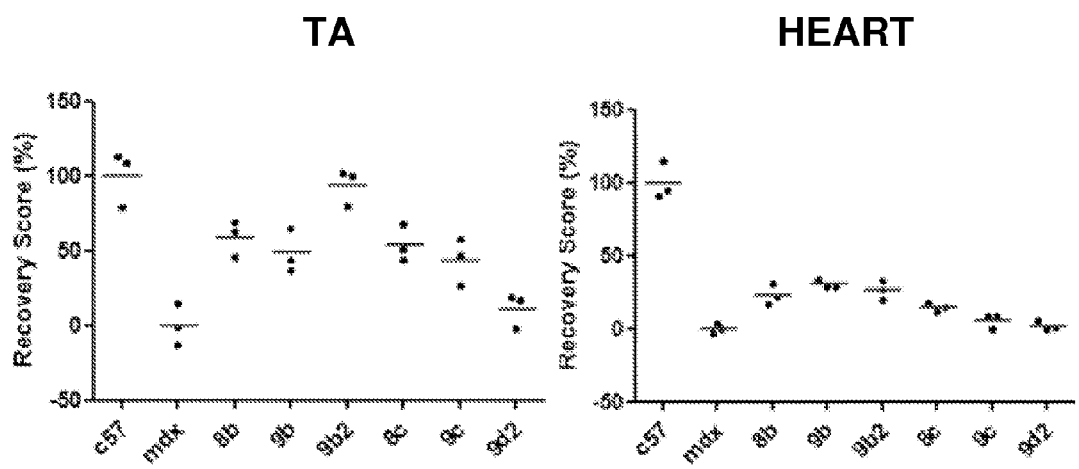
FIG. 48. Semiquantitative analysis of dystrophin restoration following intravenous injection with PPMO candidates. TA and heart muscles were immunostained using dystrophin antibody and analysed using ImagePro to show and quantify dystrophin expression.
Figure 49:
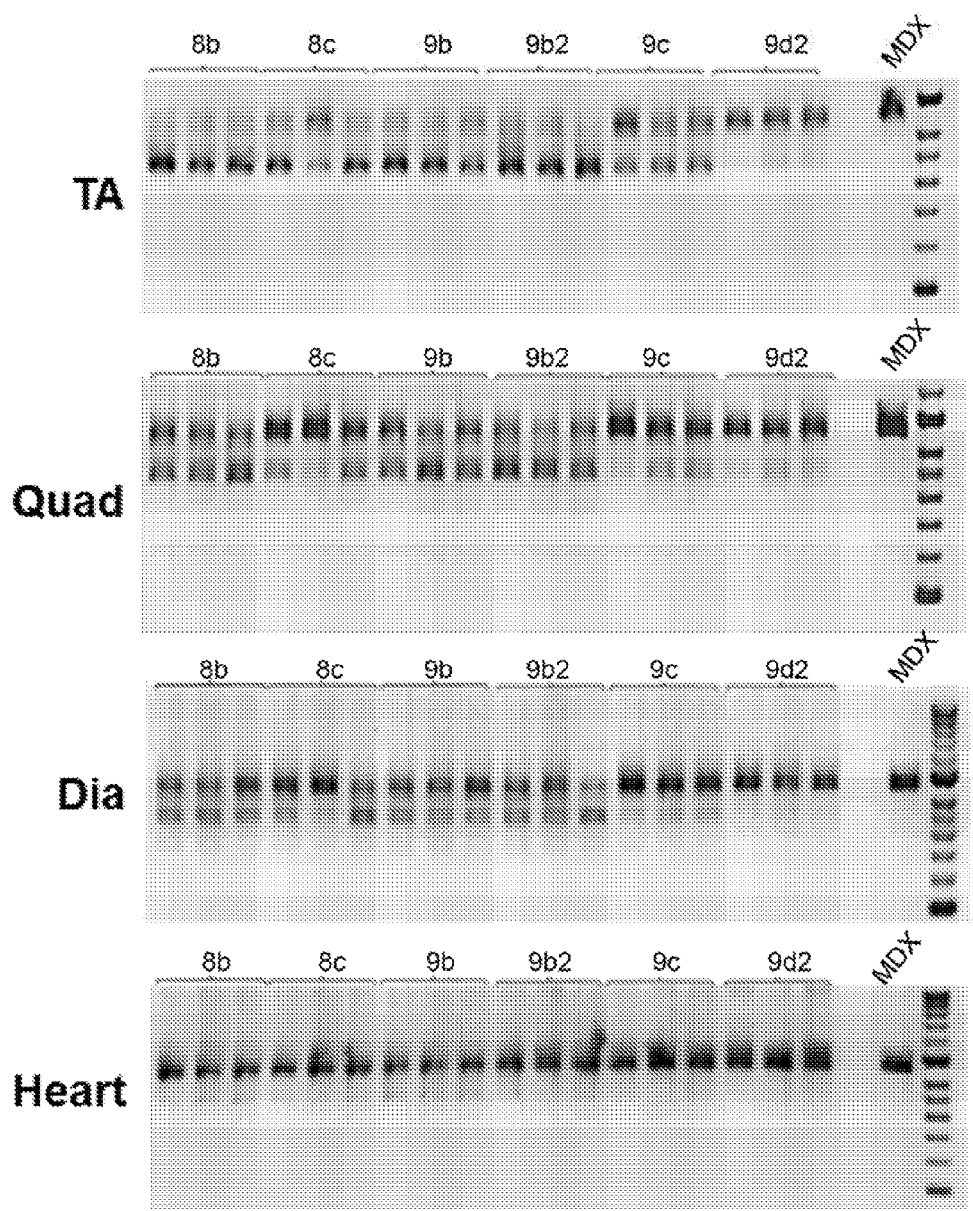
FIG. 49. Comparison of PPMO candidates following intravenous administration in mdx mice. Levels of exon skipped dystrophin RNA were evaluated following single intravenous injection at 12.5 mg/kg doses of Pip8b, 9b, 9b2, 8c, 9c and 9d2 in 8 week old mdx mice. Reverse transcriptase (RT)-PCR for detecting exon skipping efficiency at the RNA level is shown by shorter exon-skipped bands.
Figure 50A:
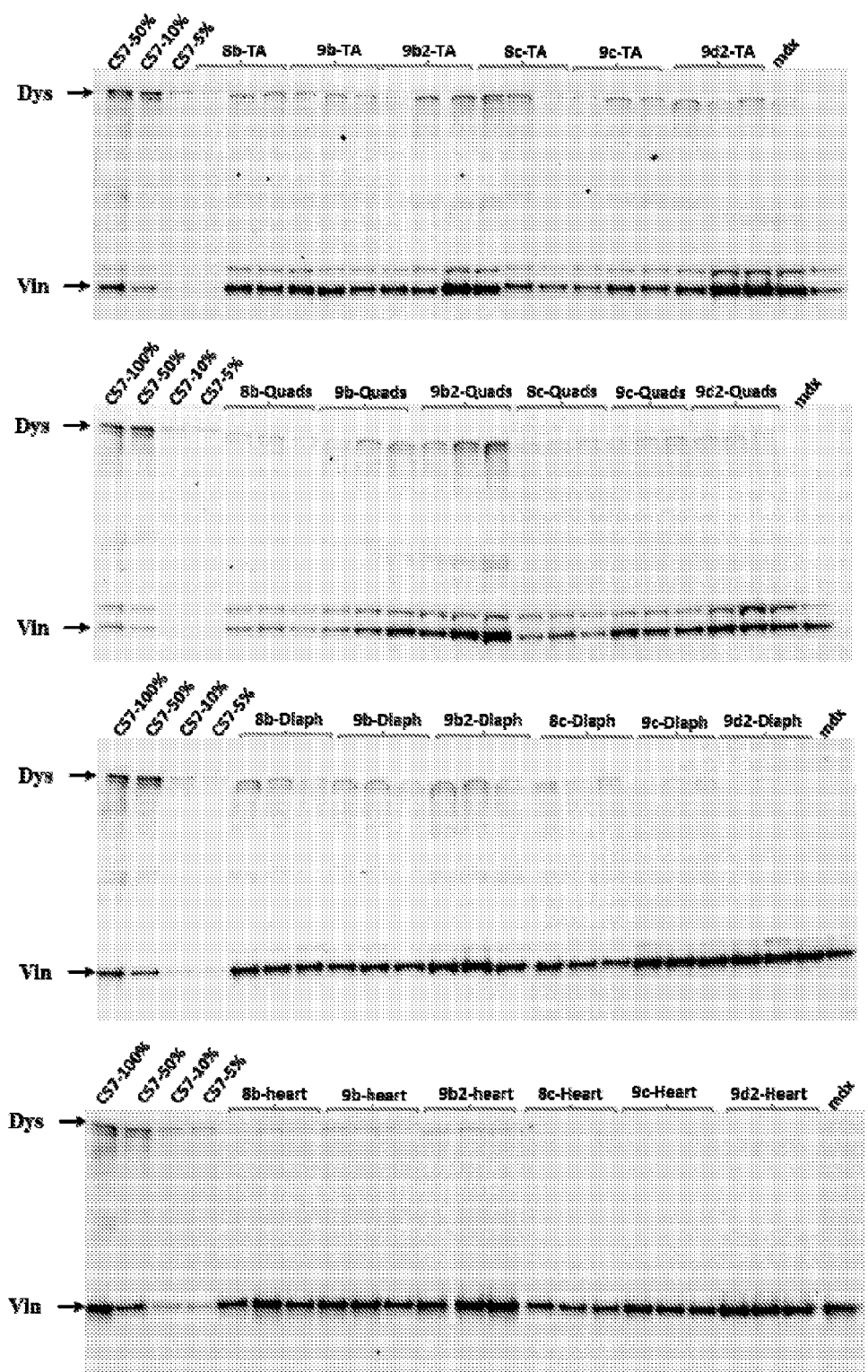
(FIG. 50a) Representative western blot images of TA, quadriceps, diaphragm and heart muscles from mdx mice treated with PPMO candidates (FIG. 50b) Charts showing semiquantitative analysis of dystrophin protein using Licor software and vinculin used as the loading control. The band density was normalised by its respective vinculin band and this was expressed as a percentage of the dystrophin expression level of C57BL/10 muscles.
Figure 50B:
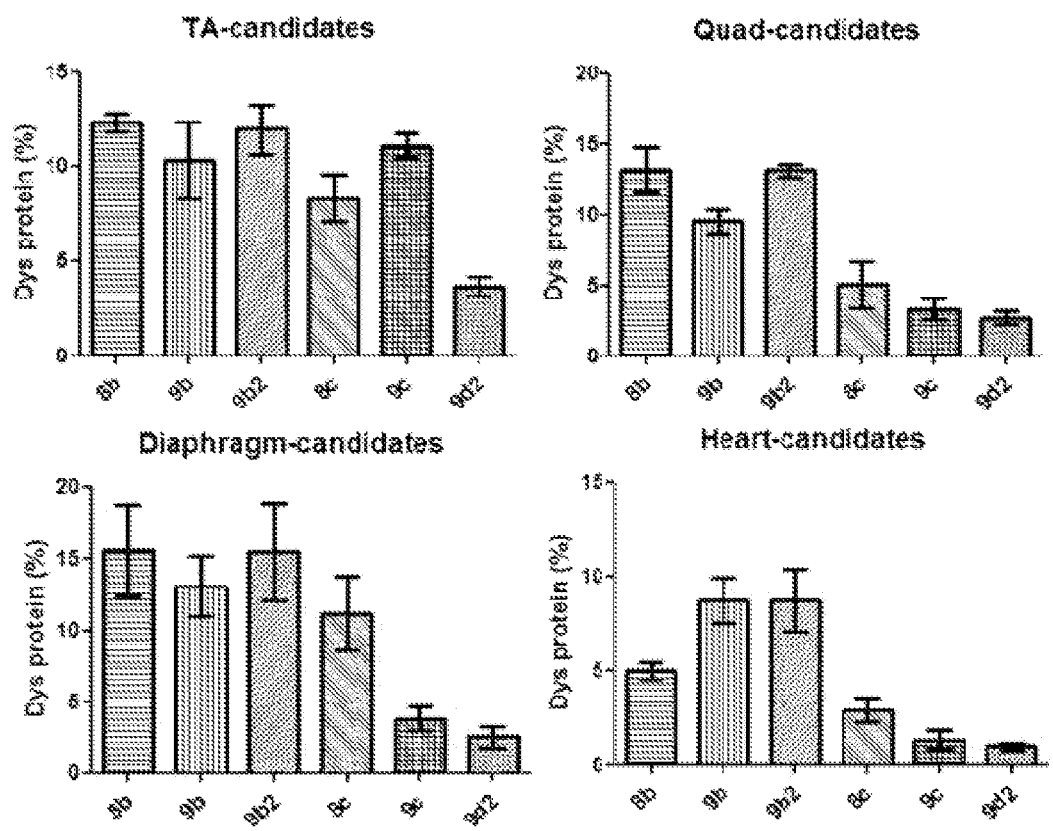
FIG. 50. Quantification of dystrophin protein level following intravenous administration of PPMO candidates in mdx mice. Western blot analysis of TA, quadriceps, diaphragm and heart muscles from mdx mice treated with PPMO candidates. Total protein was extracted from four different muscles of treated mdx mice 2 weeks after injection at 12.5 mg/kg doses of Pip8b, 9b, 9b2, 8c, 9c and 9d2. Fifteen micrograms of total protein from treated muscle samples was loaded. Vinculin was used as the loading control.

To compare exon skipping efficiency of lead PPMO, 8 week old mdx mice were intravenously injected with 12.5 mg/kg of PPMO. At 2 weeks after injection, dystrophin expression was analysed in the TA, quadriceps, diaphragm and heart muscles. We evaluated the immune-stained dystrophin positive fibres, exon skipped mRNA and dystrophin protein levels (FIGS. 48-50). The intensity of dystrophin immune-stained fibres in the TA and heart was analysed using a rat anti-laminin antibody for normalisation and this was expressed as a ratio of the intensity level of C57BL/10 muscles (FIG. 48). Levels of exon-skipped dystrophin RNA and protein was remarkably expressed in Pip8b, 9b and Pip9b2-PMO injected skeletal muscles such as TA, quadriceps, diaphragm and heart muscles at 2 weeks after injection (FIGS. 49-50). However, Pip8c and 9c-PMO rendered reduced dystrophin expression compared to Pip8b, 9b and 9b2-PMO. Moreover, Pip9d2-PMO resulted in negligible dystrophin production in TA, quadriceps, diaphragm and heart muscles (FIG. 48-50), illustrating the importance of maintaining the length of the hydrophobic region of the peptide to induce efficient exon skipping.

The dystrophin protein level in PPMO treated mdx muscles was quantified by western blot analysis. The density of the dystrophin band was quantified using Licor software and vinculin was used as the loading control. The band density was normalised by its respective vinculin band and this was expressed as a percentage of the dystrophin expression level of C57BL/10 muscles. The level of exon-skipped dystrophin protein was similar in Pip8b, 9b and 9b2-PMO injected skeletal muscles such as TA, quadriceps and diaphragm muscles at 2 weeks after injection (FIG. 50). However, Pip8c and 9c rendered reduced dystrophin expression compared to 8b, 9b and 9b2-PMO. Moreover, 9d2-PMO resulted in negligible dystrophin production in TA, quadriceps, diaphragm and heart muscles (FIG. 50).

Figure 51:
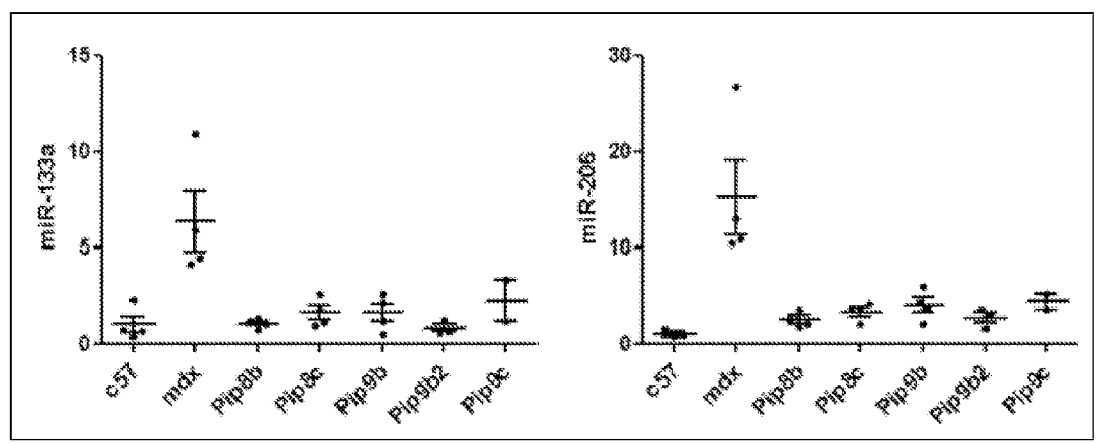
FIG. 51. Charts showing dystromir expression in PPMO treated mdx serum. At 2 weeks after intravenous injection of 12.5 mg/kg PPMO candidates (Pip8b, 9b, 9b2, 8c and 9c) at 8 weeks of age, serum was taken from the mouse jugular vein immediately after the killing by CO2 inhalation. Levels of miR-133a and miR-206 were examined by QPCR in PPMO treated serums of mdx mice and normalised to miR-223. Levels of miR-133a and miR-206 were significantly downregulated in PPMO treated serums of mdx mice compared to untreated mdx control.

Restoration of Dysregulated microRNA Levels in Lead PPMO (Exon23 Mouse) Treated mdx Mice We tested the ability of exon skipped dystrophin induced by PPMO candidates to correct microRNA levels by ameliorating the muscle pathology in the mdx mice. We evaluated the levels of dystromirs (microRNAs dysregulated in dystrophin deficiency), miR-1 and miR-133a, which were increased in mdx serum and were either decreased or unchanged in the mdx tissues and these may therefore constitute useful serum markers. At 2 weeks after intravenous injection of 12.5 mg/kg PPMO (Pip8b, 9b, 9b2, 8c and 9c) in 8 week old mdx mice, levels of miR-133a and miR-206 were examined by quantitative (Q)-PCR in PPMO treated serum and normalised to miR-223 as a reference microRNA. Levels of miR-133a and miR-206 were significantly down-regulated in PPMO treated serum of mdx mice compared to untreated mdx controls, implying that muscle pathology was improved by PPMO (FIG. 51).

Improvement of PPMO Synthesis

Figure 52:
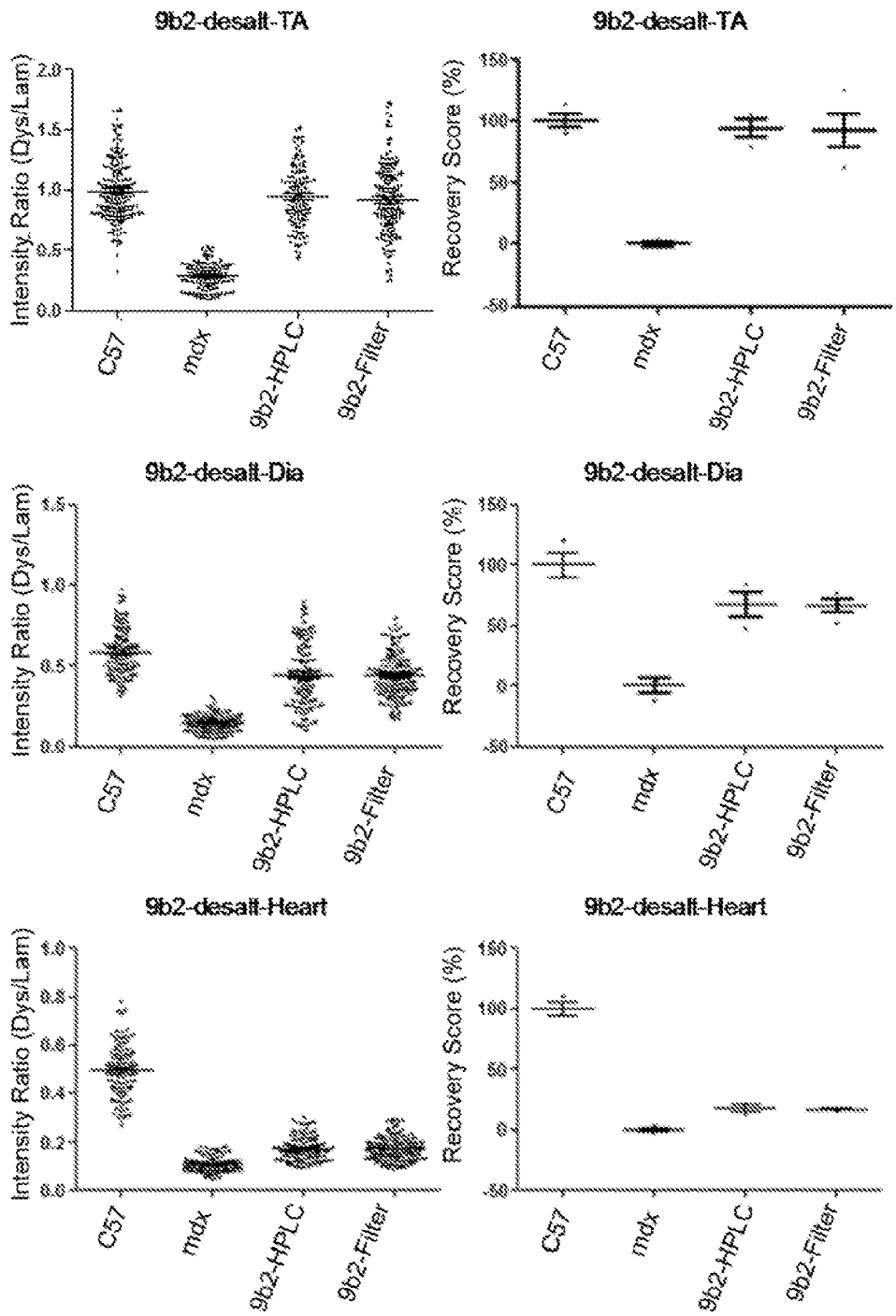
FIG. 52. Comparison of exon skipping efficiency following intravenous administration of HPLC and filter-desalted Pip9b2 conjugated PMO in mdx mice. Dystrophin expression following single intravenous injection at 12.5 mg/kg doses of HPLC and filter-desalted Pip9b-PMO in 8 week old mdx mice. The charts show semiquantitative analysis of dystrophin restoration. The intensity of dystrophin immune-stained fibres using dystrophin antibody were analysed by Image Pro software as previously reported (Arechavala-Gomeza et al., 2010) using a rat anti-laminin for normalisation and expressed as a percentage of the intensity level of C57BL/10 muscles. Relative intensity values for each region of interest (120 regions) are plotted and the mean intensity calculated (left hand panel; represented by the bar). The dystrophin staining intensity was normalised to an average of C57BL/10 (100%) and mdx (0%) muscles. The recovery score for each animal (n=4) is plotted and the mean recovery score calculated (right hand panel; represented by the bar).
Figure 53A:
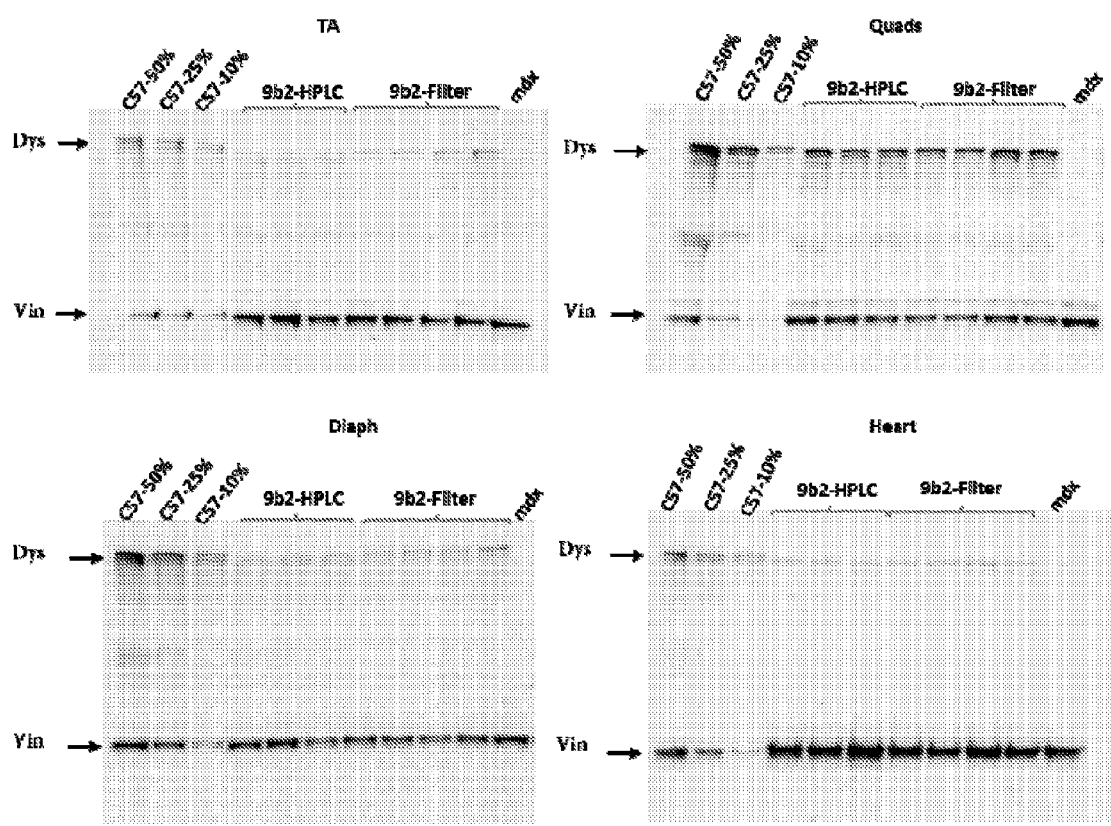
(FIG. 53a) Representative western blot images of TA, quadriceps, diaphragm and heart muscles from mdx mice treated with PPMO candidates (FIG. 53b) Chart showing semiquantitative analysis of dystrophin protein using Licor software and vinculin used as the loading control. The band density was normalised by its respective vinculin band and this was expressed as a percentage of the dystrophin expression level of C57BL/10 muscles (FIG. 53c) Reverse transcriptase (RT)-PCR for detecting exon skipping efficiency at the RNA level is shown by shorter exon-skipped bands.
Figure 53B:
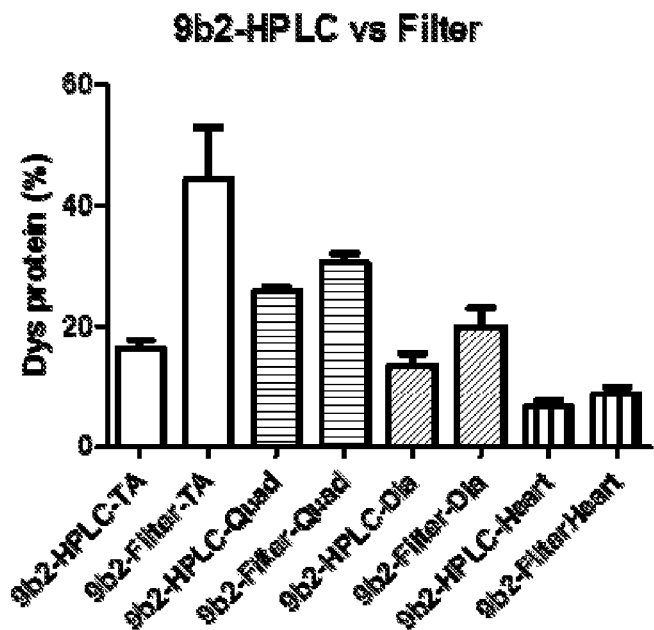
FIG. 53. Comparison of dystrophin RNA and protein level following intravenous administration of Pip9b2 conjugated PMO in mdx mice. Western blot analysis of TA, quadriceps, diaphragm and heart muscles from mdx mice treated with Pip9b2. Total protein was extracted from four different muscles of treated mdx mice 2 weeks after injection at 12.5 mg/kg doses of Pip9b2-PMO. Fifteen micrograms of total protein from treated muscle samples was loaded. Vinculin was used as the loading control.
Figure 53C:
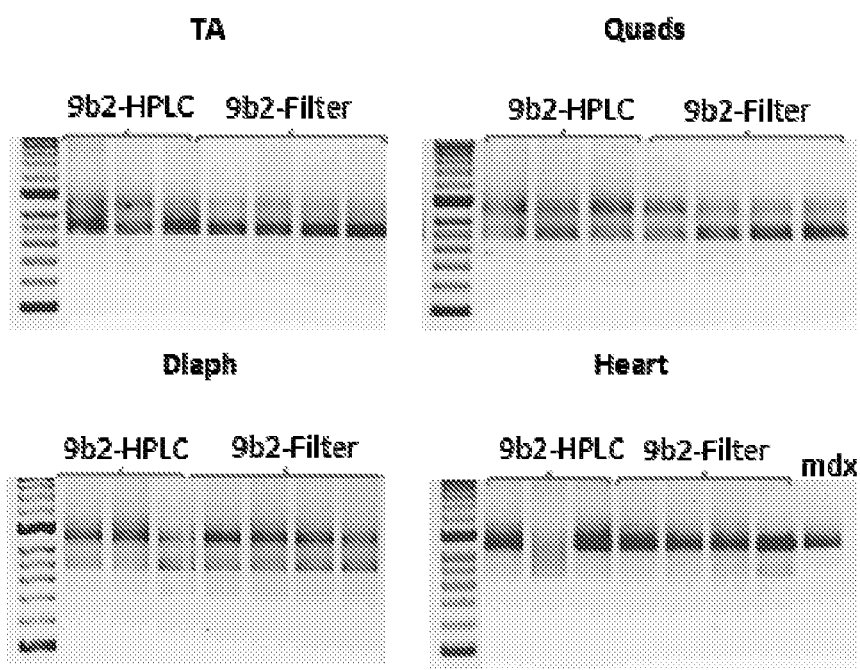
Figure 54:
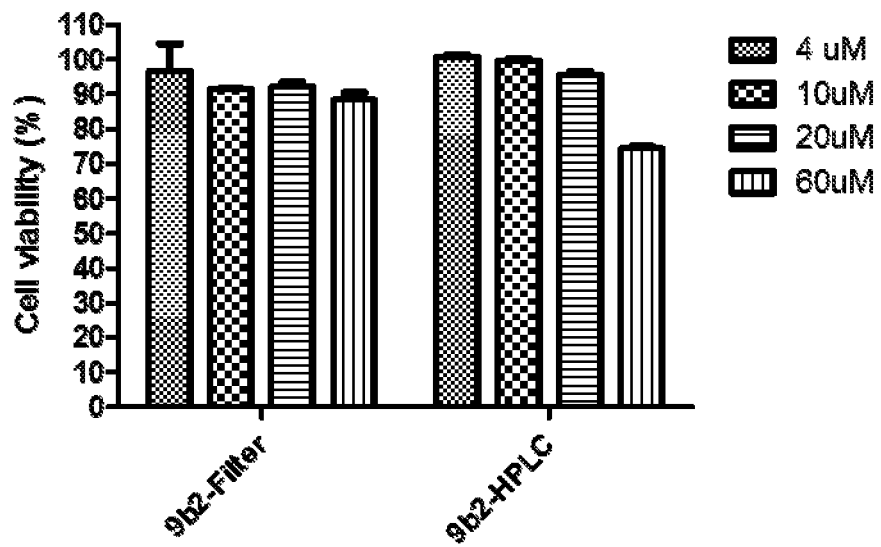
FIG. 54. Chart showing cell viability in Pip9b2-PMO treated mdx myotubes.
Figure 55:
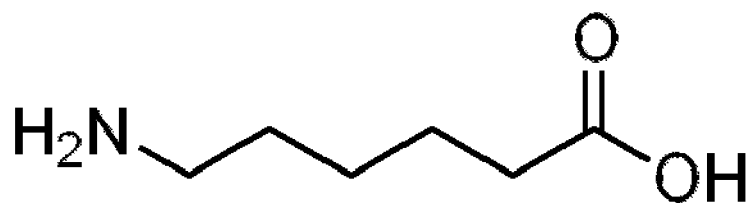
FIG. 55. Structure of aminohexanoic acid (Aminocaproic acid).
Figure 56:
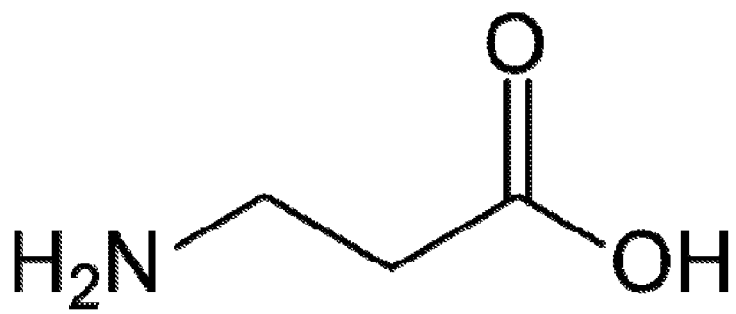
FIG. 56. Structure of betaAlanine (3-Aminopropanoic acid).

To compare exon skipping efficiency of HPLC and filter-desalted 9b2-PMO, 8 week old mdx mice were intravenously injected with 12.5 mg/kg of PPMO. At 2 weeks after injection, dystrophin expression was analysed in the TA, quadriceps, diaphragm and heart muscles. We evaluated the immune-stained dystrophin positive fibres, exon skipped mRNA and dystrophin protein levels (FIGS. 52-54). The intensity of dystrophin immune-stained fibres was analysed using a rat anti-laminin antibody for normalisation and this was expressed as a ratio of the intensity level of C57BL/10 muscles (FIG. 52). There was no change in the exon-skipped dystrophin intensity level at the sarcolemma induced by HPLC and filter-desalted 9b2-PMO. Levels of exon-skipped dystrophin RNA and protein was slightly increased in filter-desalted Pip9b2-PMO injected skeletal muscles compared to HPLC-filtered PMO treated muscles, such as TA, quadriceps and diaphragm at 2 weeks after injection (FIG. 53).

Toxicity Evaluation of Pip9b2-PMO in Cultured mdx Mouse Myotubes

Toxicity study of HPLC and filter-desalted Pip9b2-PMO was undertaken using cell viability assays. Cell viability was slightly increased in filter-desalted Pip9b2-PMO treated mdx myotubes compared to HPLC-desalted Pip9b2-PMO treated cells, when they were treated with 60 µM of Pip9b2-PMO (FIG. 54).

Summary

PPMO candidates have been identified to give high level dystrophin restoration in both skeletal and heart muscle in mdx mice. In particular, Pip8b and 9b and Pip9b2, 8c and 9c have shown efficient dystrophin restoration in the tibialis anterior (TA), diaphragm, quadriceps and heart, without apparent toxicity.

For the quantitative evaluation of DMD treatment in vivo, levels of dystromirs (miR-133a and miR-206) have been evaluated which were increased in mdx serum. Levels of miR-133a and miR-206 were significantly down-regulated in PPMO treated serums of mdx mice compared to untreated mdx control.

Example 4

Cell Viability (Pip7 and Pip8 Series)

Pip7 and Pip8 series peptides were tested in a cell viability assay, as follows. Huh-7 liver cells were grown at 37° C. under 5% $CO_2$/95% air atmosphere in DMEM supplemented with 10% fetal bovine serum and penicillin/streptomycin antibiotics. Cells were treated with trypsin and plated at 1.5× $10^4$ cells per well in 96 well plates. After overnight incubation cells were washed with PBS and PMO-Peptide conjugates in 50 µl OptiMEM were added to the wells in triplicate. After 4 hours incubation, conjugates were removed by replacement of media with 100 µl DMEM/10% FBS for a further 20 h incubation. 20 µl of MTS Cell Viability Assay (Promega) solution was added to the wells containing 100 µl DMEM and plates were incubated for 1-2 hours before the UV measurements at 490 nm were taken. The cell viability percentage was determined by normalizing the average absorbance of triplicate samples to the mean of untreated samples.

Figure 57:
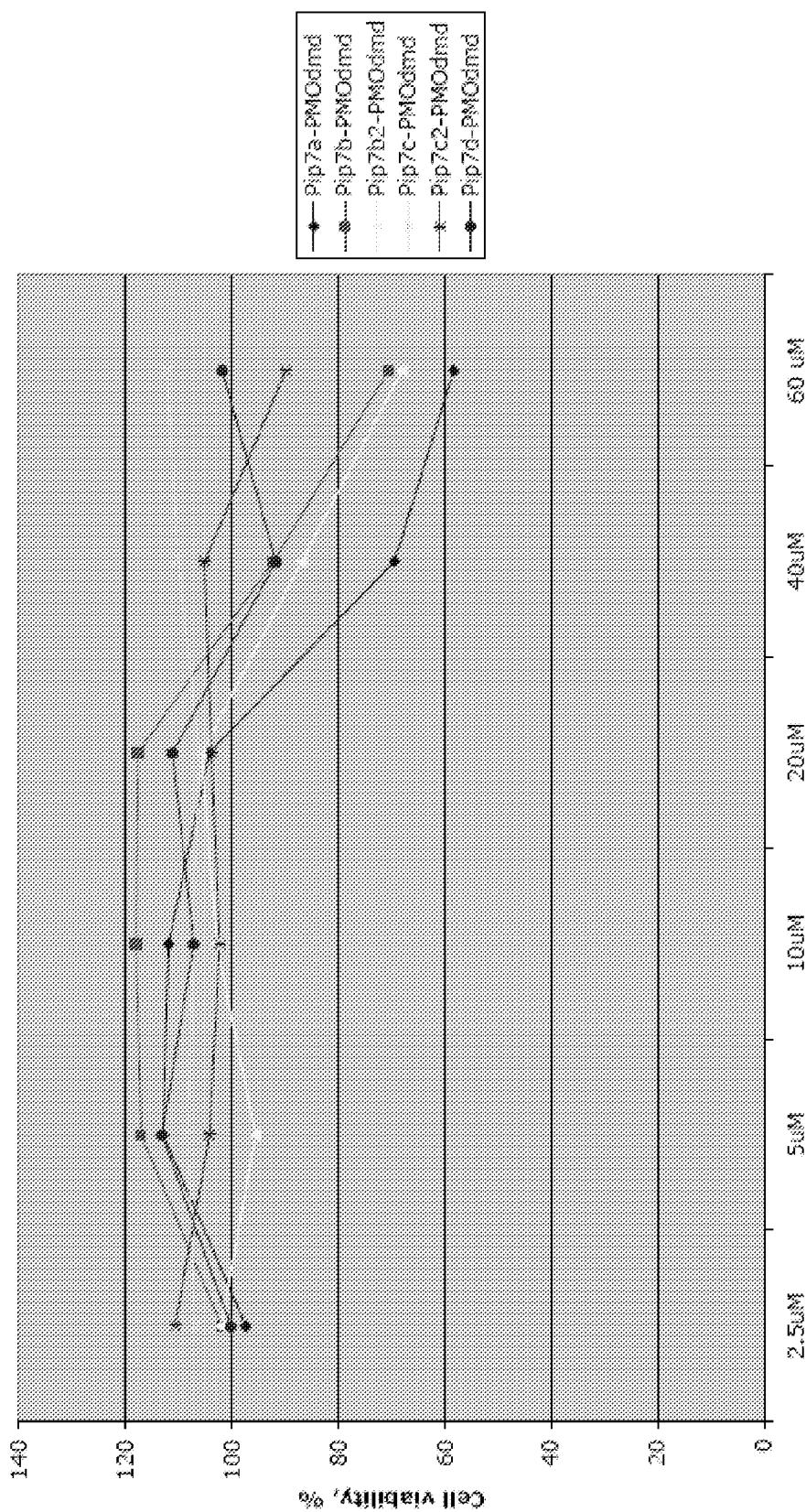
FIG. 57. Graph showing cell viability (cultured Huh-7 liver cells) of Pip7a-PMO, Pip7b-PMO, Pip7b2-PMO, Pip7c-PMO, Pip7c2-PMO, Pip7d-PNO as a function of concentration of added Pip-PMO.
Figure 58:
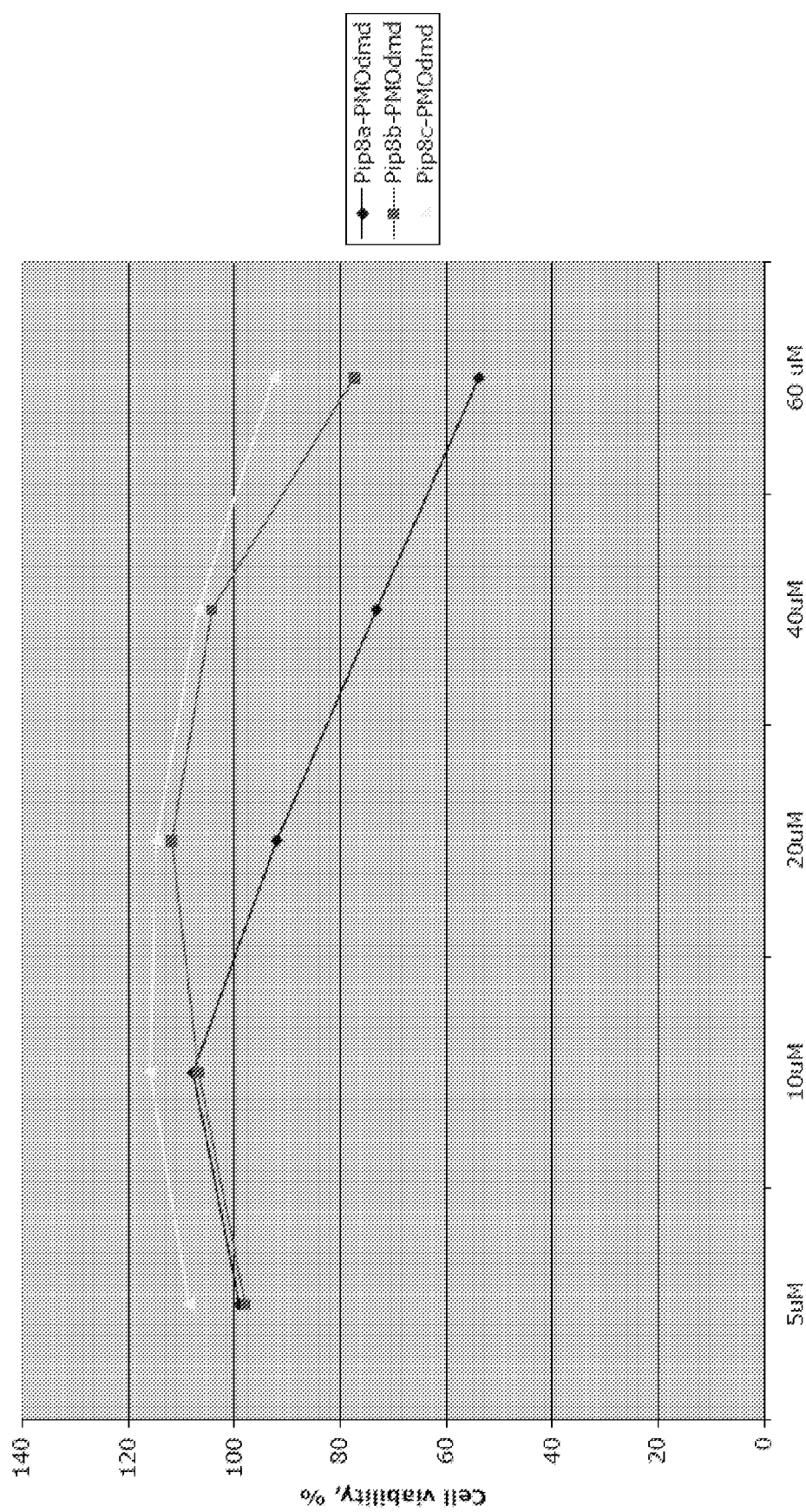
FIG. 58. Graph showing cell viability (cultured Huh-7 liver cells) of Pip8a-PMO, Pip8b-PMO, Pip8c-PMO as a function of concentration of added Pip-PMO.

Results presented (FIGS. 57 and 58) are consistent with increased cell viability (i.e. lower cellular toxicity) of peptides containing fewer Arginine residues. For example, peptides having a total of 7 Arginine residues in Domains 1-3 combined exhibited higher cell viability (lower cellular toxicity) than peptides having 8 or 9 Arginine residues.

Example 5

In Vitro Assays: Exon Skipping in Mdx Mouse Myotubes; Pip7, Pip8 and Pip9 series H2K mdx myotubes were prepared and incubated with peptide-PMO conjugates in the absence of any transfection agent at concentrations of 0.125, 0.25, 0.5, 1.0 and 2.0 µM by the method described previously [Yin, H., et al., *Pip5 transduction peptides direct high efficiency oligonucleotide-mediated dystrophin exon skipping in heart and phenotypic correction in mdx mice*. Mol Ther, 2011. 19(7): p. 1295-303.]. The products of nested RT-PCR from total isolated RNA were examined by electrophoresis on a 2% agarose gel. Quantification of Δ23 transcript levels was calculated using densitometry.

Figure 59:
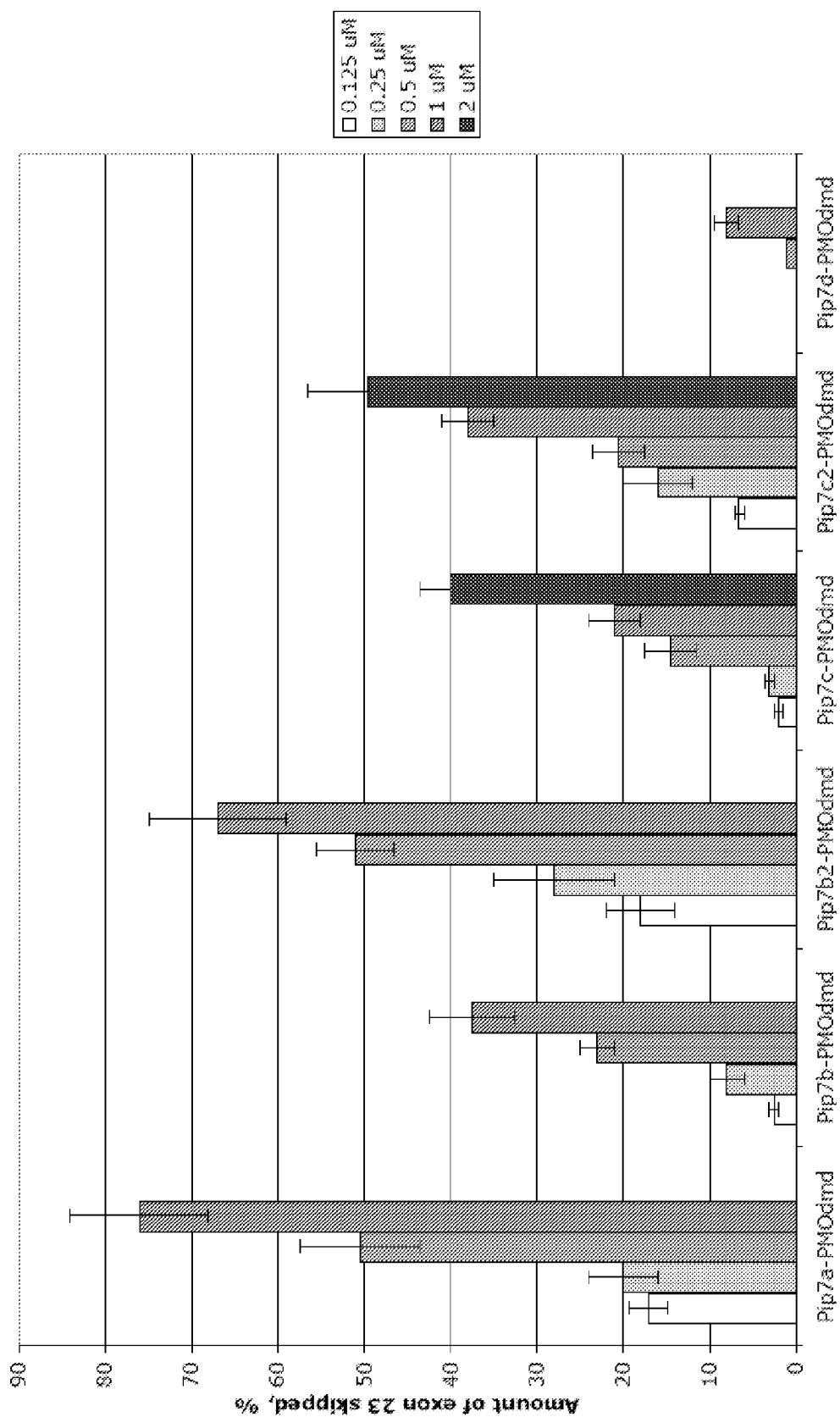
FIG. 59. Graph showing exon skipping activity of PMO-Peptides (Pip7a, Pip7b, Pip7b2, Pip7c, Pip7c2, Pip7d) in differentiated mouse H2K mdx muscle myotubes. H2K mdx myotubes were incubated with peptide-PMO conjugates at concentrations ranging between 0.125 µM to 2 µM without the use of transfection reagent. The products of nested RT-PCR were examined by electrophoresis on a 2% agarose gel. Exon skipping activity is presented as the percentage of Δ23 skipping as calculated by densitometry.
Figure 60:
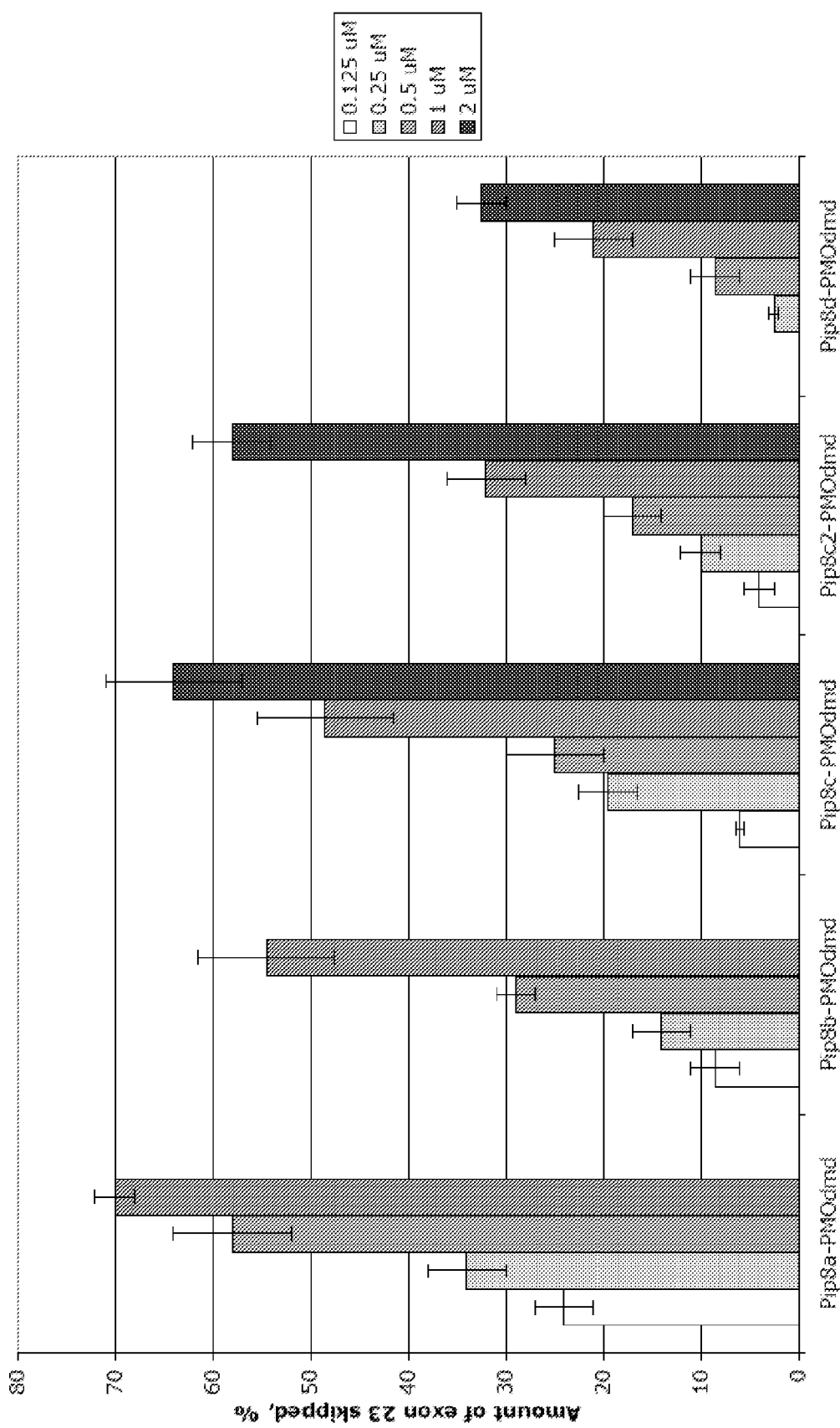
FIG. 60. Graph showing exon skipping activity of PMO-Peptides (Pip8a, Pip8b, Pip8c, Pip8c2, Pip8d) in differentiated mouse H2K mdx muscle myotubes. H2K mdx myotubes were incubated with peptide-PMO conjugates at concentrations ranging between 0.125 µM to 2 µM without the use of transfection reagent. The products of nested RT-PCR were examined by electrophoresis on a 2% agarose gel. Exon skipping activity is presented as the percentage of Δ23 skipping as calculated by densitometry.
Figure 61:
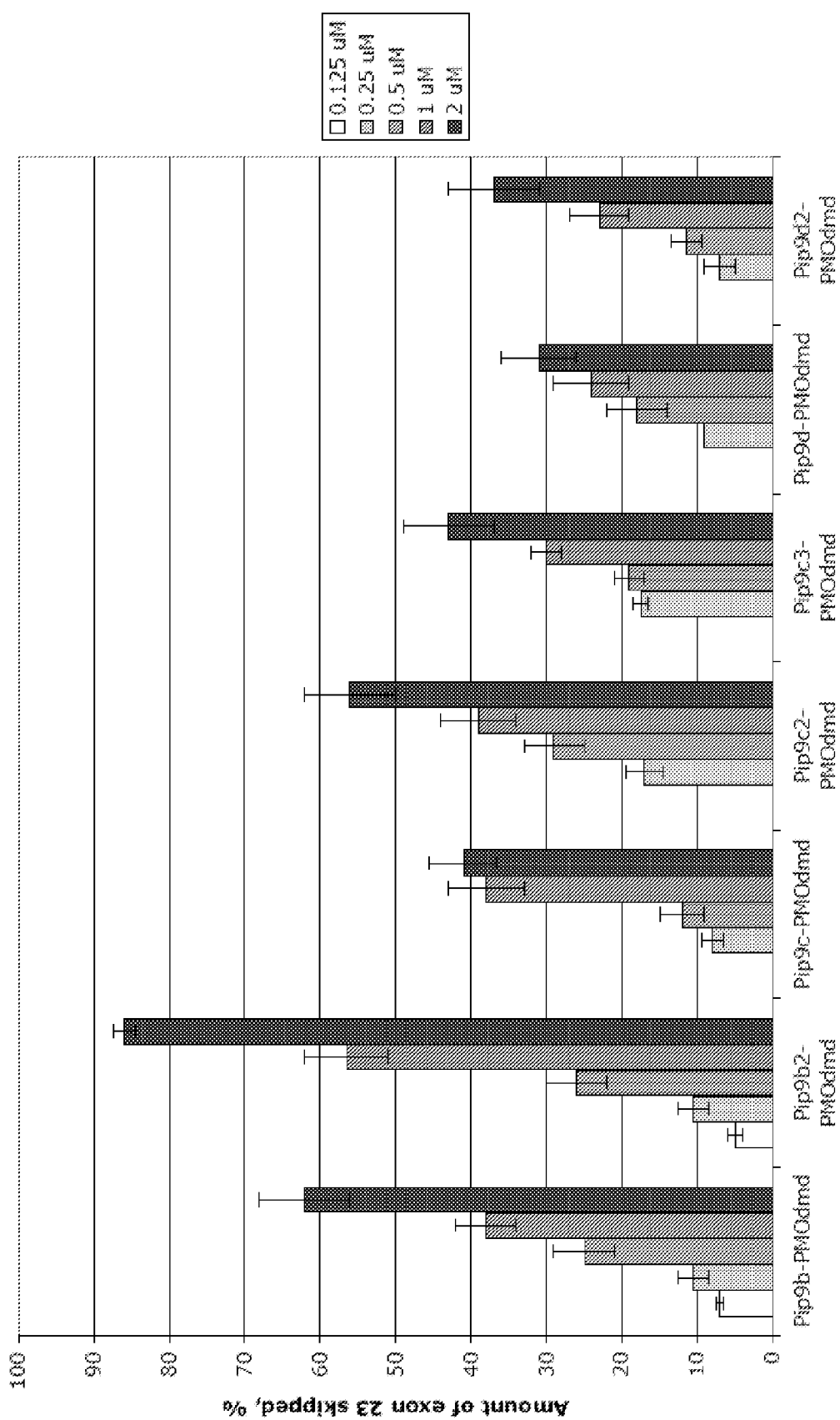
FIG. 61. Graph showing exon skipping activity of PMO-Peptides (Pip9b, Pip9b2, Pip9c, Pip9c2, Pip9c3, Pip9d, Pip9d2) in differentiated mouse H2K mdx muscle myotubes. H2K mdx myotubes were incubated with peptide-PMO conjugates at concentrations ranging between 0.125 µM to 2 µM without the use of transfection reagent. The products of nested RT-PCR were examined by electrophoresis on a 2% agarose gel. Exon skipping activity is presented as the percentage of Δ23 skipping as calculated by densitometry.

The results (FIGS. 59 to 61) show that Pip7a, Pip7b, Pip7b2, Pip7c, Pip7c2, Pip8a, Pip8b, Pip8c, Pip8c2, Pip8d, Pip9b, Pip9b2, Pip9c, pip9c2, Pip9c3, pip9d and Pip9d2 PMO conjugates gave high exon skipping activity in mdx muscle cells.

REFERENCES

1. Kurreck J.: *Eur. J. Biochem.* 2003, 270, 1628.
2. Eckstein F.: *Expert Opin. Biol. Ther.* 2007, 7, 1021.
3. Egholm M., Buchardt O., Nielsen P. E., Berg R. H.: *J. Amer. Chem. Soc.* 1992, 114, 1895.
4. Summerton J., Weller D.: *Antisense Nucl. Acid Drug Dev.* 1997, 7, 187.
5. Lebleu B., Moulton H. M., Abes R., Ivanova G. D., Abes S., Stein D. A., Iversen P. L., Arzumanov A., Gait M. J.: *Adv. Drug Delivery Rev.* 2008, 60, 517.
6. Zatsepin T. S., Turner J. J., Oretskaya T. S., Gait M. J.: *Curr. Pharm. Design* 2005, 11, 3639.
7. Abes R., Arzumanov A., Moulton H. M., Abes S., Ivanova G. D., Iversen P. L., Gait M. J., Lebleu B.: *Biochem. Soc. Trans.* 2007, 35, 775.
8. Turner J. J., Arzumanov A., Ivanova G., Fabani M., Gait M. J.: Cell-Penetrating Peptides, 2nd Edition. (U. Lange) Ed.) 2006, CRC Press, Boca Raton. 313.
9. Turner J. J., Jones S., Fabani M., Ivanova G., Arzumanov A., Gait M. J.: *Blood, Cells, Molecules and Diseases* 2007, 38, 1.
10. Kang S.-H., Cho M.-J., Kole R.: *Biochemistry* 1998, 37, 6235.
11. Bendifallah N., Rasmussen F. W., Zachar V., Ebbesen P., Nielsen P. E., Koppelhus U.: *Bioconjugate Chem.* 2006, 17, 750.
12. El-Andaloussi S., Johansson H. J., Lundberg P., Langel U.: *J. Gene Medicine* 2006, 8, 1262.
13. El-Andaloussi S., Johansson H. J., Holm T., Langel U.: *Mol. Ther.* 2007, 15, 1820.
14. Abes S., Williams D., Prevot P., Thierry A. R., Gait M. J., Lebleu B.: *J. Controlled Release* 2006, 110, 595.
15. Abes S., Moulton H. M., Turner J. J., Clair P., Richard J.-P., Iversen P. L., Gait M. J., Lebleu B.: *Biochem. Soc. Trans.* 2007, 35, 53.
16. Abes S., Moulton H. M., Clair P., Prevot P., Youngblood D. S., Wu R. P., Iversen P. L., Lebleu B.: *J. Controlled Release* 2006, 116, 304.
17. Turner J. J., Arzumanov A. A., Gait M. J.: *Nucl. Acids Res.* 2005, 33, 27.
18. Turner J. J., Ivanova G. D., Verbeure B., Williams D., Arzumanov A., Abes S., Lebleu B., Gait M. J.: *Nucl. Acids Res.* 2005, 33, 6837.
19. Abes S., Turner J. J., Ivanova G. D., Owen D., Williams D., Arzumanov A., Clair P., Gait M. J., Lebleu B.: *Nucl. Acids Res.* 2007, 35, 4495.
20. Fabani M., Gait M. J.: *RNA* 2008, 14, 336.
21. Moulton H. M., Nelson M. H., Hatlevig S. A., Reddy M. T., Iversen P. L.: *Bioconjugate Chem.* 2004, 15, 290.
22. Kichler A., Leborgne C., J. M., Danos O., Bechinger B.: *Proc. Natl. Acad. Sci. USA* 2003, 100, 1564.
23. Yin H., Lu Q., Wood M.: *Mol. Ther.* 2008, 16, 38.
24. Fletcher S., Honeyman K., Fall A. M., Harding P. L., Johnsen R. D., Wilton S. D.: *J Gene Med.* 2006, 8, 207.
25. Soifer H. S., Rossi J. J., Saetrom P.: *Mol. Ther.* 2007, 15, 2070.
26. Jopling C. L., Yi M., Lancaster A. M., Lemon S. M., Sarnow P.: *Science* 2005, 309, 1577.
27. Krützfeldt J., Rajewsky N., Braich R., Rajeev K. G., Tuschl T., Manoharan M., Stoffel M.: *Nature* 2005, 438, 685.
28. Esau C., Davis S., Murray S. F., Yu X. X., Pandey S. K., Pear M., Watts L., Booten S. L., Graham M., Mckay R., Subramanian A., Propp S., Lollo B. A., Freier S. M., Bennett C. F., Bhanot S., Monia B. P.: *Cell Metabolism* 2006, 3, 87.
29. Cossu, G. and Sampaolesi, M. (2007) *Trends Mol. Medicine*, 13 520-526.
30. Aartsma-Rus, A. and van Ommen, G.-J. B. (2007) *RNA*, 13, 1609-1624.

31. Lu, Q. et al (2005) *Proc. Natl. Acad. Sci. USA,* 102, 198-203.
33. Alter, J. et al (2006) *Nature Medicine,* 12, 175-177.
34. van Deutekom, J. et al (2007) *New England J. Med.* 357, 2677-2686.
35. Arechavala-Gomeza, V. et al (2007) *Human Gene Therapy,* 18, 798-810.
36. Lebleu, B. et al. (2008) *Adv. Drug Delivery Rev.* 60, 517-529.
37. Fletcher, S. et al (2007) *Mol. Ther.* 15, 1587-1592.
38. Madsen, E. C., Morcos, P. A., Mendelsohn, B. A., and Gitlin, J. D. (2008) *Proc. Natl. Acad. Sci. USA,* 105, 3909-3914
39. Kole, R. Vacek, M., and Williams T. (2004) *Oligonucleotides,* 14, 65-74).
40. Scaffidi, P. and Mistelli, T. (2006) *Science,* 312, 1059-1063
41. Du, L. et al (2007) *Proc. Natl. Acad. Sci. USA* 104, 6007-6012
42. Yin, H. et al (2008) *Human Mol. Gen.* 17, 3909-3918;
43. Wu. B. et al (2008) *Proc. Natl. Acad. Sci. USA* 105, 14814-14819
44. Jearawiriyapaisarn, N. et al (2008) *Mol. Ther.* 16, 1624-1629
45. Moulton et al. (2004) *Bioconjugate Chem.* 15, 290-299.
46. Seabra, L. and Warenius, H. (2007) *Eur. J. Cancer* 43, 1483-1492.
47. Gillis, Jean-Marie (Jul. 31, 2008) "The recovery score to evaluate therapy efficiency in NMD: a common quantitative and comparative scoring system," Treat-NMD Neuromuscular Network.

SEQUENCE LISTING (818 sequences)

SEQ ID NO: 1 - protein, 22 aa, Artificial sequence
  Synthetic sequence: Pip-5e
  SITE (2)..(2): Xaa is aminohexanoic acid
  SITE (8)..(8): Xaa is aminohexanoic acid
  SITE (16)..(16): Xaa is aminohexanoic acid
  SITE (20)..(20): Xaa is aminohexanoic acid
  MOD_RES (5)..(5): bAla
  MOD_RES (18)..(18): bAla
  MOD_RES (22)..(22): bAla
RXRRARRXRILFQYRXRARXRA

SEQ ID NO: 2 - protein, 22 aa, Artificial sequence
  Synthetic sequence: Pip-6a
  SITE (2)..(2): Xaa is aminohexanoic acid
  SITE (8)..(8): Xaa is aminohexanoic acid
  SITE (16)..(16): Xaa is aminohexanoic acid
  SITE (20)..(20): Xaa is aminohexanoic acid
  MOD_RES (5)..(5): bAla
  MOD_RES (18)..(18): bAla
  MOD_RES (22)..(22): bAla
RXRRARRXRYQFLIRXRARXRA

SEQ ID NO: 3 - protein, 22 aa, Artificial sequence
  Synthetic sequence: Pip-6b
  SITE (2)..(2): Xaa is aminohexanoic acid
  SITE (8)..(8): Xaa is aminohexanoic acid
  SITE (16)..(16): Xaa is aminohexanoic acid
  SITE (20)..(20): Xaa is aminohexanoic acid
  MOD_RES (5)..(5): bAla
  MOD_RES (18)..(18): bAla
  MOD_RES (22)..(22): bAla
RXRRARRXRIQFLIRXRARXRA

SEQ ID NO: 4 - protein, 21 aa, Artificial sequence
  Synthetic sequence: Pip-6c
  SITE (2)..(2): Xaa is aminohexanoic acid
  SITE (8)..(8): Xaa is aminohexanoic acid
  SITE (15)..(15): Xaa is aminohexanoic acid
  SITE (19)..(19): Xaa is aminohexanoic acid
  MOD_RES (5)..(5): bAla
  MOD_RES (17)..(17): bAla
  MOD_RES (21)..(21): bAla
RXRRARRXRQFLIRXRARXRA

SEQ ID NO: 5 - protein, 20 aa, Artificial sequence
  Synthetic sequence: Pip-6d
  SITE (2)..(2): Xaa is aminohexanoic acid
  SITE (8)..(8): Xaa is aminohexanoic acid
  SITE (14)..(14): Xaa is aminohexanoic acid
  SITE (18)..(18): Xaa is aminohexanoic acid
  MOD_RES (5)..(5): bAla
  MOD_RES (16)..(16): bAla
  MOD_RES (20)..(20): bAla
RXRRARRXRQFLRXRARXRA

SEQ ID NO: 6 - protein, 21 aa, Artificial sequence
  Synthetic sequence: Pip-6e
  SITE (2)..(2): Xaa is aminohexanoic acid
  SITE (8)..(8): Xaa is aminohexanoic acid
  SITE (15)..(15): Xaa is aminohexanoic acid
  SITE (19)..(19): Xaa is aminohexanoic acid
  MOD_RES (5)..(5): bAla
  MOD_RES (17)..(17): bAla
  MOD_RES (21)..(21): bAla
RXRRARRXYRFLIRXRARXRA

SEQ ID NO: 7 - protein, 22 aa, Artificial sequence
  Synthetic sequence: Pip-6f
  SITE (2)..(2): Xaa is aminohexanoic acid
  SITE (8)..(8): Xaa is aminohexanoic acid
  SITE (16)..(16): Xaa is aminohexanoic acid
  SITE (20)..(20): Xaa is aminohexanoic acid
  MOD_RES (5)..(5): bAla
  MOD_RES (18)..(18): bAla
  MOD_RES (22)..(22): bAla
RXRRARRXRFQILYRXRARXRA

SEQ ID NO: 8 - protein, 21 aa, Artificial sequence
  Synthetic sequence: Pip-6g
  SITE (2)..(2): Xaa is aminohexanoic acid
  SITE (8)..(8): Xaa is aminohexanoic acid
  SITE (15)..(15): Xaa is aminohexanoic acid
  SITE (19)..(19): Xaa is aminohexanoic acid
  MOD_RES (5)..(5): bAla
  MOD_RES (17)..(17): bAla
  MOD_RES (21)..(21): bAla
RXRRARRXYRFRLIXRARXRA

SEQ ID NO: 9 - protein, 21 aa, Artificial sequence
  Synthetic sequence: Pip-6h
  SITE (2)..(2): Xaa is aminohexanoic acid
  SITE (8)..(8): Xaa is aminohexanoic acid
  SITE (15)..(15): Xaa is aminohexanoic acid
  SITE (19)..(19): Xaa is aminohexanoic acid
  MOD_RES (5)..(5): bAla
  MOD_RES (17)..(17): bAla
  MOD_RES (21)..(21): bAla
RXRRARRXILFRYRXRARXRA

SEQ ID NO: 10 - protein, 21 aa, Artificial sequence
  Synthetic sequence: Pip-6i
  SITE (2)..(2): Xaa is aminohexanoic acid
  SITE (8)..(8): Xaa is aminohexanoic acid
  SITE (16)..(16): Xaa is aminohexanoic acid
  MOD_RES (5)..(5): bAla
  MOD_RES (19)..(19): bAla
  MOD_RES (21)..(21): bAla
RXRRARRXRYQFLIRXRRARA

SEQ ID NO: 11 - protein, 20 aa, Artificial sequence
  Synthetic sequence: Pip-7a
  SITE (2)..(2): Xaa is aminohexanoic acid
  SITE (8)..(8): Xaa is aminohexanoic acid
  SITE (14)..(14): Xaa is aminohexanoic acid
  SITE (18)..(18): Xaa is aminohexanoic acid
  MOD_RES (5)..(5): bAla
  MOD_RES (16)..(16): bAla
  MOD_RES (20)..(20): bAla
RXRRARRXYRFLIXRARXRA

SEQ ID NO: 12 - protein, 19 aa, Artificial sequence
  Synthetic sequence: Pip-7b
  SITE (2)..(2): Xaa is aminohexanoic acid
  SITE (7)..(7): Xaa is aminohexanoic acid
  SITE (13)..(13): Xaa is aminohexanoic acid
  SITE (17)..(17): Xaa is aminohexanoic acid
  MOD_RES (5)..(5): bAla
  MOD_RES (15)..(15): bAla
  MOD_RES (19)..(19): bAla
RXRRARXYRFLIXRARXRA

SEQ ID NO: 13 - protein, 18 aa, Artificial sequence
  Synthetic sequence: Pip-7c
  SITE (2)..(2): Xaa is aminohexanoic acid
  SITE (6)..(6): Xaa is aminohexanoic acid
  SITE (12)..(12): Xaa is aminohexanoic acid
  SITE (16)..(16): Xaa is aminohexanoic acid
  MOD_RES (4)..(4): bAla
  MOD_RES (14)..(14): bAla
  MOD_RES (18)..(18): bAla
RXRARXYRFLIXRARXRA

SEQ ID NO: 14 - protein, 17 aa, Artificial sequence
  Synthetic sequence: Pip-7d
  SITE (2)..(2): Xaa is aminohexanoic acid
  SITE (5)..(5): Xaa is aminohexanoic acid
  SITE (11)..(11): Xaa is aminohexanoic acid
  SITE (15)..(15): Xaa is aminohexanoic acid
  MOD_RES (4)..(4): bAla
  MOD_RES (13)..(13): bAla
  MOD_RES (17)..(17): bAla
RXRAXYRFLIXRARXRA

SEQ ID NO: 15 - protein, 18 aa, Artificial sequence
  Synthetic sequence: Pip-7b2
  SITE (2)..(2): Xaa is aminohexanoic acid
  SITE (8)..(8): Xaa is aminohexanoic acid
  SITE (16)..(16): Xaa is aminohexanoic acid
  MOD_RES (5)..(5): bAla
  MOD_RES (14)..(14): bAla
  MOD_RES (18)..(18): bAla
RXRRARRXYRFLIARXRA

SEQ ID NO: 16 - protein, 17 aa, Artificial sequence
  Synthetic sequence: Pip-7c2
  SITE (2)..(2): Xaa is aminohexanoic acid
  SITE (7)..(7): Xaa is aminohexanoic acid
  SITE (15)..(15): Xaa is aminohexanoic acid
  MOD_RES (5)..(5): bAla
  MOD_RES (13)..(13): bAla
  MOD_RES (17)..(17): bAla
RXRRARXYRFLIARXRA

SEQ ID NO: 17 - protein, 20 aa, Artificial sequence
  Synthetic sequence: Pip-8a
  SITE (2)..(2): Xaa is aminohexanoic acid
  SITE (7)..(7): Xaa is aminohexanoic acid
  SITE (15)..(15): Xaa is aminohexanoic acid
  MOD_RES (5)..(5): bAla
  MOD_RES (18)..(18): bAla
  MOD_RES (20)..(20): bAla
RXRRARXRYQFLIRXRRARA

SEQ ID NO: 18 - protein, 18 aa, Artificial sequence
  Synthetic sequence: Pip-8b
  SITE (2)..(2): Xaa is aminohexanoic acid
  SITE (13)..(13): Xaa is aminohexanoic acid
  MOD_RES (5)..(5): bAla
  MOD_RES (16)..(16): bAla
  MOD_RES (18)..(18): bAla
RXRRARYQFLIRXRRARA

SEQ ID NO: 19 - protein, 17 aa, Artificial sequence
  Synthetic sequence: Pip-8c
  SITE (2)..(2): Xaa is aminohexanoic acid
  SITE (12)..(12): Xaa is aminohexanoic acid
  MOD_RES (5)..(5): bAla
  MOD_RES (15)..(15): bAla
  MOD_RES (17)..(17): bAla
RXRRARYQFLIXRRARA

SEQ ID NO: 20 - protein, 16 aa, Artificial sequence
  Synthetic sequence: Pip-8c2
  SITE (2)..(2): Xaa is aminohexanoic acid
  MOD_RES (5)..(5): bAla
  MOD_RES (14)..(14): bAla
  MOD_RES (16)..(16): bAla
RXRRARYQFLIRRARA

SEQ ID NO: 21 - protein, 22 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  VARIANT (20)..(20): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (22)..(22): bAla
RXRRARRXRYQFLIRXRARXRA

SEQ ID NO: 22 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXRYQFLIXRARXRA

SEQ ID NO: 23 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (19)..(19): bAla
  MOD_RES (21)..(21): bAla
RXRRARRXRYQFLIRXRRARA

SEQ ID NO: 24 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXRYQFLIARXRA

SEQ ID NO: 25 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRYQFLIXRRARA

SEQ ID NO: 26 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRYQFLIRRARA

SEQ ID NO: 27 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXYQFLIRXRARXRA

SEQ ID NO: 28 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXYQFLIXRARXRA

SEQ ID NO: 29 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXYQFLIRXRRARA

SEQ ID NO: 30 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRXYQFLIARXRA

SEQ ID NO: 31 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXYQFLIXRRARA

SEQ ID NO: 32 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXYQFLIRRARA

SEQ ID NO: 33 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXYQFLIRXRARXRA

SEQ ID NO: 34 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXYQFLIXRARXRA

SEQ ID NO: 35 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXYQFLIRXRRARA

SEQ ID NO: 36 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARXYQFLIARXRA

SEQ ID NO: 37 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXYQFLIXRRARA

SEQ ID NO: 38 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXYQFLIRRARA

SEQ ID NO: 39 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (19)..(19): bAla
RXRARXYQFLIRXRARXRA

SEQ ID NO: 40 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRARXYQFLIXRARXRA

SEQ ID NO: 41 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (16)..(16): bAla
  MOD_RES (18)..(18): bAla
RXRARXYQFLIRXRRARA

SEQ ID NO: 42 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRARXYQFLIARXRA

SEQ ID NO: 43 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXYQFLIXRRARA

SEQ ID NO: 44 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXYQFLIRRARA

SEQ ID NO: 45 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARXRYQFLIRXRARXRA

SEQ ID NO: 46 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXRYQFLIXRARXRA

SEQ ID NO: 47 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARXRYQFLIRXRRARA

SEQ ID NO: 48 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXRYQFLIARXRA

SEQ ID NO: 49 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRYQFLIXRRARA

SEQ ID NO: 50 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRYQFLIRRARA

SEQ ID NO: 51 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARYQFLIRXRARXRA

SEQ ID NO: 52 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARYQFLIXRARXRA

SEQ ID NO: 53 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARYQFLIRXRRARA

SEQ ID NO: 54 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARYQFLIARXRA

SEQ ID NO: 55 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARYQFLIXRRARA

SEQ ID NO: 56 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARYQFLIRRARA

SEQ ID NO: 57 - protein, 22 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  VARIANT (20)..(20): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (22)..(22): bAla
RXRRARRXRIQFLIRXRARXRA

SEQ ID NO: 58 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXRIQFLIXRARXRA

SEQ ID NO: 59 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (19)..(19): bAla
  MOD_RES (21)..(21): bAla
RXRRARRXRIQFLIRXRRARA

SEQ ID NO: 60 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXRIQFLIARXRA

SEQ ID NO: 61 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRIQFLIXRRARA

SEQ ID NO: 62 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRIQFLIRRARA

SEQ ID NO: 63 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXIQFLIRXRARXRA

SEQ ID NO: 64 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXIQFLIXRARXRA

SEQ ID NO: 65 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXIQFLIRXRRARA

SEQ ID NO: 66 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRXIQFLIARXRA

SEQ ID NO: 67 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXIQFLIXRRARA

SEQ ID NO: 68 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXIQFLIRRARA

SEQ ID NO: 69 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXIQFLIRXRARXRA

SEQ ID NO: 70 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXIQFLIXRARXRA

SEQ ID NO: 71 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXIQFLIRXRRARA

SEQ ID NO: 72 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARXIQFLIARXRA

SEQ ID NO: 73 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXIQFLIXRRARA

SEQ ID NO: 74 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXIQFLIRRARA

SEQ ID NO: 75 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (19)..(19): bAla
RXRARXIQFLIRXRARXRA

SEQ ID NO: 76 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRARXIQFLIXRARXRA

SEQ ID NO: 77 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (16)..(16): bAla
  MOD_RES (18)..(18): bAla
RXRARXIQFLIRXRRARA

SEQ ID NO: 78 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRARXIQFLIARXRA

SEQ ID NO: 79 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXIQFLIXRRARA

SEQ ID NO: 80 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXIQFLIRRARA

SEQ ID NO: 81 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARXRIQFLIRXRARXRA

SEQ ID NO: 82 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXRIQFLIXRARXRA

SEQ ID NO: 83 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARXRIQFLIRXRRARA

SEQ ID NO: 84 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXRIQFLIARXRA

SEQ ID NO: 85 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRIQFLIXRRARA

SEQ ID NO: 86 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRIQFLIRRARA

SEQ ID NO: 87 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARIQFLIRXRARXRA

SEQ ID NO: 88 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARIQFLIXRARXRA

SEQ ID NO: 89 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARIQFLIRXRRARA

SEQ ID NO: 90 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARIQFLIARXRA

SEQ ID NO: 91 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARIQFLIXRRARA

SEQ ID NO: 92 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARIQFLIRRARA

SEQ ID NO: 93 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXRQFLIRXRARXRA

SEQ ID NO: 94 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXRQFLIXRARXRA

SEQ ID NO: 95 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRQFLIRXRRARA

SEQ ID NO: 96 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRXRQFLIARXRA

SEQ ID NO: 97 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRQFLIXRRARA

SEQ ID NO: 98 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXRQFLIRRARA

SEQ ID NO: 99 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXQFLIRXRARXRA

SEQ ID NO: 100 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXQFLIXRARXRA

SEQ ID NO: 101 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXQFLIRXRRARA

SEQ ID NO: 102 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARRXQFLIARXRA

SEQ ID NO: 103 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXQFLIXRRARA

SEQ ID NO: 104 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRXQFLIRRARA

SEQ ID NO: 105 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXQFLIRXRARXRA

SEQ ID NO: 106 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXQFLIXRARXRA

SEQ ID NO: 107 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXQFLIRXRRARA

SEQ ID NO: 108 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARXQFLIARXRA

SEQ ID NO: 109 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXQFLIXRRARA

SEQ ID NO: 110 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARXQFLIRRARA

SEQ ID NO: 111 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRARXQFLIRXRARXRA

SEQ ID NO: 112 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRARXQFLIXRARXRA

SEQ ID NO: 113 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXQFLIRXRRARA

SEQ ID NO: 114 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (15)..(15): bAla
RXRARXQFLIARXRA

SEQ ID NO: 115 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXQFLIXRRARA

SEQ ID NO: 116 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRARXQFLIRRARA

SEQ ID NO: 117 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXRQFLIRXRARXRA

SEQ ID NO: 118 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXRQFLIXRARXRA

SEQ ID NO: 119 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRQFLIRXRRARA

SEQ ID NO: 120 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARXRQFLIARXRA

SEQ ID NO: 121 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRQFLIXRRARA

SEQ ID NO: 122 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXRQFLIRRARA

SEQ ID NO: 123 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARQFLIRXRARXRA

SEQ ID NO: 124 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARQFLIXRARXRA

SEQ ID NO: 125 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARQFLIRXRRARA

SEQ ID NO: 126 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRARQFLIARXRA

SEQ ID NO: 127 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARQFLIXRRARA

SEQ ID NO: 128 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRARQFLIRRARA

SEQ ID NO: 129 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXRQFLRXRARXRA

SEQ ID NO: 130 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXRQFLXRARXRA

SEQ ID NO: 131 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRQFLRXRRARA

SEQ ID NO: 132 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARRXRQFLARXRA

SEQ ID NO: 133 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXRQFLXRRARA

SEQ ID NO: 134 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRXRQFLRRARA

SEQ ID NO: 135 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXQFLRXRARXRA

SEQ ID NO: 136 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRXQFLXRARXRA

SEQ ID NO: 137 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXQFLRXRRARA

SEQ ID NO: 138 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARRXQFLARXRA

SEQ ID NO: 139 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRXQFLXRRARA

SEQ ID NO: 140 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARRXQFLRRARA

SEQ ID NO: 141 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXQFLRXRARXRA

SEQ ID NO: 142 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARXQFLXRARXRA

SEQ ID NO: 143 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXQFLRXRRARA

SEQ ID NO: 144 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRARXQFLARXRA

SEQ ID NO: 145 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARXQFLXRRARA

SEQ ID NO: 146 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRARXQFLRRARA

SEQ ID NO: 147 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRARXQFLRXRARXRA

SEQ ID NO: 148 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRARXQFLXRARXRA

SEQ ID NO: 149 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXQFLRXRRARA

SEQ ID NO: 150 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (10)..(10): bAla
  MOD_RES (14)..(14): bAla
RXRARXQFLARXRA

SEQ ID NO: 151 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRARXQFLXRRARA

SEQ ID NO: 152 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
RXRARXQFLRRARA

SEQ ID NO: 153 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXRQFLRXRARXRA

SEQ ID NO: 154 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXRQFLXRARXRA

SEQ ID NO: 155 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRQFLRXRRARA

SEQ ID NO: 156 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARXRQFLARXRA

SEQ ID NO: 157 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXRQFLXRRARA

SEQ ID NO: 158 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARXRQFLRRARA

SEQ ID NO: 159 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARQFLRXRARXRA

SEQ ID NO: 160 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARQFLXRARXRA

SEQ ID NO: 161 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARQFLRXRRARA

SEQ ID NO: 162 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (10)..(10): bAla
  MOD_RES (14)..(14): bAla
RXRRARQFLARXRA

SEQ ID NO: 163 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRARQFLXRRARA

SEQ ID NO: 164 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
RXRRARQFLRRARA

SEQ ID NO: 165 - protein, 22 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  VARIANT (20)..(20): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (22)..(22): bAla
RXRRARRXRYRFLIRXRARXRA

SEQ ID NO: 166 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXRYRFLIXRARXRA

SEQ ID NO: 167 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (19)..(19): bAla
  MOD_RES (21)..(21): bAla
RXRRARRXRYRFLIRXRRARA

SEQ ID NO: 168 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXRYRFLIARXRA

SEQ ID NO: 169 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRYRFLIXRRARA

SEQ ID NO: 170 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRYRFLIRRARA

SEQ ID NO: 171 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXYRFLIRXRARXRA

SEQ ID NO: 172 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXYRFLIXRARXRA

SEQ ID NO: 173 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXYRFLIRXRRARA

SEQ ID NO: 174 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRXYRFLIARXRA

SEQ ID NO: 175 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXYRFLIXRRARA

SEQ ID NO: 176 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXYRFLIRRARA

SEQ ID NO: 177 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXYRFLIRXRARXRA

SEQ ID NO: 178 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXYRFLIXRARXRA

SEQ ID NO: 179 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXYRFLIRXRRARA

SEQ ID NO: 180 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARXYRFLIARXRA

SEQ ID NO: 181 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXYRFLIXRRARA

SEQ ID NO: 182 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXYRFLIRRARA

SEQ ID NO: 183 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (19)..(19): bAla
RXRARXYRFLIRXRARXRA

SEQ ID NO: 184 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRARXYRFLIXRARXRA

SEQ ID NO: 185 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (16)..(16): bAla
  MOD_RES (18)..(18): bAla
RXRARXYRFLIRXRRARA

SEQ ID NO: 186 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRARXYRFLIARXRA

SEQ ID NO: 187 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXYRFLIXRRARA

SEQ ID NO: 188 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXYRFLIRRARA

SEQ ID NO: 189 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARXRYRFLIRXRARXRA

SEQ ID NO: 190 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXRYRFLIXRARXRA

SEQ ID NO: 191 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARXRYRFLIRXRRARA

SEQ ID NO: 192 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXRYRFLIARXRA

SEQ ID NO: 193 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRYRFLIXRRARA

SEQ ID NO: 194 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRYRFLIRRARA

SEQ ID NO: 195 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARYRFLIRXRARXRA

SEQ ID NO: 196 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARYRFLIXRARXRA

SEQ ID NO: 197 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARYRFLIRXRRARA

SEQ ID NO: 198 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARYRFLIARXRA

SEQ ID NO: 199 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARYRFLIXRRARA

SEQ ID NO: 200 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARYRFLIRRARA

SEQ ID NO: 201 - protein, 22 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  VARIANT (20)..(20): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (22)..(22): bAla
RXRRARRXRFQILYRXRARXRA

SEQ ID NO: 202 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXRFQILYXRARXRA

SEQ ID NO: 203 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (19)..(19): bAla
  MOD_RES (21)..(21): bAla
RXRRARRXRFQILYRXRRARA

SEQ ID NO: 204 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXRFQILYARXRA

SEQ ID NO: 205 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRFQILYXRRARA

SEQ ID NO: 206 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRFQILYRRARA

SEQ ID NO: 207 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXFQILYRXRARXRA

SEQ ID NO: 208 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXFQILYXRARXRA

SEQ ID NO: 209 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXFQILYRXRRARA

SEQ ID NO: 210 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRXFQILYARXRA

SEQ ID NO: 211 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXFQILYXRRARA

SEQ ID NO: 212 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXFQILYRRARA

SEQ ID NO: 213 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXFQILYRXRARXRA

SEQ ID NO: 214 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXFQILYXRARXRA

SEQ ID NO: 215 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXFQILYRXRRARA

SEQ ID NO: 216 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARXFQILYARXRA

SEQ ID NO: 217 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXFQILYXRRARA

SEQ ID NO: 218 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXFQILYRRARA

SEQ ID NO: 219 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (19)..(19): bAla
RXRARXFQILYRXRARXRA

SEQ ID NO: 220 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRARXFQILYXRARXRA

SEQ ID NO: 221 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (16)..(16): bAla
  MOD_RES (18)..(18): bAla
RXRARXFQILYRXRRARA

SEQ ID NO: 222 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRARXFQILYARXRA

SEQ ID NO: 223 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXFQILYXRRARA

SEQ ID NO: 224 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXFQILYRRARA

SEQ ID NO: 225 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARXRFQILYRXRARXRA

SEQ ID NO: 226 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXRFQILYXRARXRA

SEQ ID NO: 227 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARXRFQILYRXRRARA

SEQ ID NO: 228 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXRFQILYARXRA

SEQ ID NO: 229 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRFQILYXRRARA

SEQ ID NO: 230 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRFQILYRRARA

SEQ ID NO: 231 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARFQILYRXRARXRA

SEQ ID NO: 232 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARFQILYXRARXRA

SEQ ID NO: 233 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARFQILYRXRRARA

SEQ ID NO: 234 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARFQILYARXRA

SEQ ID NO: 235 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARFQILYXRRARA

SEQ ID NO: 236 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARFQILYRRARA

SEQ ID NO: 237 - protein, 23 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  VARIANT (21)..(21): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (19)..(19): bAla
  MOD_RES (23)..(23): bAla
RXRRARRXRYRFRLIRXRARXRA

SEQ ID NO: 238 - protein, 22 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  VARIANT (20)..(20): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (22)..(22): bAla
RXRRARRXRYRFRLIXRARXRA

SEQ ID NO: 239 - protein, 22 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (20)..(20): bAla
  MOD_RES (22)..(22): bAla
RXRRARRXRYRFRLIRXRRARA

SEQ ID NO: 240 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXRYRFRLIARXRA

SEQ ID NO: 241 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (19)..(19): bAla
  MOD_RES (21)..(21): bAla
RXRRARRXRYRFRLIXRRARA

SEQ ID NO: 242 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRYRFRLIRRARA

SEQ ID NO: 243 - protein, 22 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  VARIANT (20)..(20): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (22)..(22): bAla
RXRRARRXYRFRLIRXRARXRA

SEQ ID NO: 244 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXYRFRLIXRARXRA

SEQ ID NO: 245 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (19)..(19): bAla
  MOD_RES (21)..(21): bAla
RXRRARRXYRFRLIRXRRARA

SEQ ID NO: 246 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXYRFRLIARXRA

SEQ ID NO: 247 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXYRFRLIXRRARA

SEQ ID NO: 248 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXYRFRLIRRARA

SEQ ID NO: 249 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARXYRFRLIRXRARXRA

SEQ ID NO: 250 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXYRFRLIXRARXRA

SEQ ID NO: 251 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARXYRFRLIRXRRARA

SEQ ID NO: 252 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXYRFRLIARXRA

SEQ ID NO: 253 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXYRFRLIXRRARA

SEQ ID NO: 254 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXYRFRLIRRARA

SEQ ID NO: 255 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (16)..(16): bAla
  MOD_RES (20)..(20): bAla
RXRARXYRFRLIRXRARXRA

SEQ ID NO: 256 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (19)..(19): bAla
RXRARXYRFRLIXRARXRA

SEQ ID NO: 257 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (17)..(17): bAla
  MOD_RES (19)..(19): bAla
RXRARXYRFRLIRXRRARA

SEQ ID NO: 258 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRARXYRFRLIARXRA

SEQ ID NO: 259 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (16)..(16): bAla
  MOD_RES (18)..(18): bAla
RXRARXYRFRLIXRRARA

SEQ ID NO: 260 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXYRFRLIRRARA

SEQ ID NO: 261 - protein, 22 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  VARIANT (20)..(20): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (22)..(22): bAla
RXRRARXRYRFRLIRXRARXRA

SEQ ID NO: 262 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARXRYRFRLIXRARXRA

SEQ ID NO: 263 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (19)..(19): bAla
  MOD_RES (21)..(21): bAla
RXRRARXRYRFRLIRXRRARA

SEQ ID NO: 264 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXRYRFRLIARXRA

SEQ ID NO: 265 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARXRYRFRLIXRRARA

SEQ ID NO: 266 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRYRFRLIRRARA

SEQ ID NO: 267 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARYRFRLIRXRARXRA

SEQ ID NO: 268 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARYRFRLIXRARXRA

SEQ ID NO: 269 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARYRFRLIRXRRARA

SEQ ID NO: 270 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARYRFRLIARXRA

SEQ ID NO: 271 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARYRFRLIXRRARA

SEQ ID NO: 272 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARYRFRLIRRARA

SEQ ID NO: 273 - protein, 22 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  VARIANT (20)..(20): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (22)..(22): bAla
RXRRARRXRILFRYRXRARXRA

SEQ ID NO: 274 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXRILFRYXRARXRA

SEQ ID NO: 275 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (19)..(19): bAla
  MOD_RES (21)..(21): bAla
RXRRARRXRILFRYRXRRARA

SEQ ID NO: 276 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXRILFRYARXRA

SEQ ID NO: 277 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRILFRYXRRARA

SEQ ID NO: 278 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRILFRYRRARA

SEQ ID NO: 279 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXILFRYRXRARXRA

SEQ ID NO: 280 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXILFRYXRARXRA

SEQ ID NO: 281 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXILFRYRXRRARA

SEQ ID NO: 282 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRXILFRYARXRA

SEQ ID NO: 283 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXILFRYXRRARA

SEQ ID NO: 284 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXILFRYRRARA

SEQ ID NO: 285 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXILFRYRXRARXRA

SEQ ID NO: 286 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXILFRYXRARXRA

SEQ ID NO: 287 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXILFRYRXRRARA

SEQ ID NO: 288 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARXILFRYARXRA

SEQ ID NO: 289 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXILFRYXRRARA

SEQ ID NO: 290 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXILFRYRRARA

SEQ ID NO: 291 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (19)..(19): bAla
RXRARXILFRYRXRARXRA

SEQ ID NO: 292 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRARXILFRYXRARXRA

SEQ ID NO: 293 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (16)..(16): bAla
  MOD_RES (18)..(18): bAla
RXRARXILFRYRXRRARA

SEQ ID NO: 294 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRARXILFRYARXRA

SEQ ID NO: 295 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXILFRYXRRARA

SEQ ID NO: 296 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXILFRYRRARA

SEQ ID NO: 297 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARXRILFRYRXRARXRA

SEQ ID NO: 298 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXRILFRYXRARXRA

SEQ ID NO: 299 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARXRILFRYRXRRARA

SEQ ID NO: 300 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXRILFRYARXRA

SEQ ID NO: 301 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRILFRYXRRARA

SEQ ID NO: 302 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRILFRYRRARA

SEQ ID NO: 303 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARILFRYRXRARXRA

SEQ ID NO: 304 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARILFRYXRARXRA

SEQ ID NO: 305 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARILFRYRXRRARA

SEQ ID NO: 306 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARILFRYARXRA

SEQ ID NO: 307 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARILFRYXRRARA

SEQ ID NO: 308 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARILFRYRRARA

SEQ ID NO: 309 - DNA, 20 bp, Artificial sequence
  Synthetic sequence: PNADMD
ggccaaacctcggcttacct

SEQ ID NO: 310 - DNA, 25 bp, Artificial sequence
  Synthetic sequence: PMODMD
ggccaaacctcggcttacctgaaat

SEQ ID NO: 311 - protein, 14 aa, Artificial sequence
  Synthetic sequence: B-peptide
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (14)..(14): bAla
RXRRARRXRRARXA

SEQ ID NO: 312 - DNA, 22 bp, Artificial sequence
  Synthetic sequence: Forward primer
cagaattctgccaattgctgag

SEQ ID NO: 313 - DNA, 20 bp, Artificial sequence
  Synthetic sequence: Reverse primer
ttcttcagcttgtgtcatcc

SEQ ID NO: 314 - DNA, 24 bp, Artificial sequence
  Synthetic sequence: Forward primer
cccagtctaccaccctatcagagc

SEQ ID NO: 315 - DNA, 20 bp, Artificial sequence
  Synthetic sequence: Reverse primer
cctgcctttaaggcttcctt

SEQ ID NO: 316 - DNA, 18 bp, Artificial sequence
  Synthetic sequence: PNA705
cctcttacctcagttaca

SEQ ID NO: 317 - protein, 16 aa, Artificial sequence
  Synthetic sequence: Pip-8d
  SITE (2)..(2): Xaa is aminohexanoic acid
  SITE (14)..(14): Xaa is aminohexanoic acid
  MOD_RES (5)..(5): bAla
  MOD_RES (12)..(12): bAla
  MOD_RES (16)..(16): bAla
RXRRARYQFLIARXRA

SEQ ID NO: 318 - protein, 16 aa, Artificial sequence
  Synthetic sequence: Pip-8d2
  SITE (2)..(2): Xaa is aminohexanoic acid
  SITE (12)..(12): Xaa is aminohexanoic acid
  MOD_RES (5)..(5): bAla
  MOD_RES (14)..(14): bAla
  MOD_RES (16)..(16): bAla
RXRRARYQFLIXRARA

SEQ ID NO: 319 - protein, 16 aa, Artificial sequence
  Synthetic sequence: Pip-8d3
  SITE (2)..(2): Xaa is aminohexanoic acid
  SITE (11)..(11): Xaa is aminohexanoic acid
  MOD_RES (5)..(5): bAla
  MOD_RES (14)..(14): bAla
  MOD_RES (16)..(16): bAla
RXRRAYQFLIXRRARA

SEQ ID NO: 320 - protein, 18 aa, Artificial sequence
  Synthetic sequence: Pip-9b
  SITE (2)..(2): Xaa is aminohexanoic acid
  SITE (13)..(13): Xaa is aminohexanoic acid
  MOD_RES (5)..(5): bAla
  MOD_RES (16)..(16): bAla
  MOD_RES (18)..(18): bAla
RXRRARFQILYRXRRARA

SEQ ID NO: 321 - protein, 18 aa, Artificial sequence
  Synthetic sequence: Pip-9b2
  SITE (2)..(2): Xaa is aminohexanoic acid
  SITE (16)..(16): Xaa is aminohexanoic acid
  MOD_RES (5)..(5): bAla
  MOD_RES (14)..(14): bAla
  MOD_RES (18)..(18): bAla
RXRRARRFQILYRARXRA

SEQ ID NO: 322 - protein, 17 aa, Artificial sequence
  Synthetic sequence: Pip-9c
  SITE (2)..(2): Xaa is aminohexanoic acid
  SITE (13)..(13): Xaa is aminohexanoic acid
  MOD_RES (5)..(5): bAla
  MOD_RES (15)..(15): bAla
  MOD_RES (17)..(17): bAla
RXRRARFQILYRXRARA

SEQ ID NO: 323 - protein, 17 aa, Artificial sequence
  Synthetic sequence: Pip-9c2
  SITE (2)..(2): Xaa is aminohexanoic acid
  SITE (15)..(15): Xaa is aminohexanoic acid
  MOD_RES (5)..(5): bAla
  MOD_RES (13)..(13): bAla
  MOD_RES (17)..(17): bAla
RXRRARRFQILYARXRA

SEQ ID NO: 324 - protein, 16 aa, Artificial sequence
  Synthetic sequence: Pip-9c3
  SITE (2)..(2): Xaa is aminohexanoic acid
  MOD_RES (5)..(5): bAla
  MOD_RES (14)..(14): bAla
  MOD_RES (16)..(16): bAla
RXRRARFQILYRRARA

SEQ ID NO: 325 - protein, 16 aa, Artificial sequence
  Synthetic sequence: Pip-9d
  SITE (2)..(2): Xaa is aminohexanoic acid
  MOD_RES (5)..(5): bAla
  MOD_RES (12)..(12): bAla
  MOD_RES (14)..(14): bAla
  MOD_RES (16)..(16): bAla
RXRRARFQILYARARA

SEQ ID NO: 326 - protein, 16 aa, Artificial sequence
  Synthetic sequence: Pip-9d2
  SITE (2)..(2): Xaa is aminohexanoic acid
  SITE (14)..(14): Xaa is aminohexanoic acid
  MOD_RES (5)..(5): bAla
  MOD_RES (12)..(12): bAla
  MOD_RES (16)..(16): bAla
RXRRARFQILYARXRA

SEQ ID NO: 327 - protein, 16 aa, Artificial sequence
  Synthetic sequence: Pip-9d3
  SITE (2)..(2): Xaa is aminohexanoic acid
  SITE (12)..(12): Xaa is aminohexanoic acid
  MOD_RES (5)..(5): bAla
  MOD_RES (14)..(14): bAla
  MOD_RES (16)..(16): bAla
RXRRARFQILYXRARA

SEQ ID NO: 328 - protein, 16 aa, Artificial sequence
  Synthetic sequence: Pip-9d4
  SITE (2)..(2): Xaa is aminohexanoic acid
  SITE (12)..(12): Xaa is aminohexanoic acid
  MOD_RES (5)..(5): bAla
  MOD_RES (14)..(14): bAla
  MOD_RES (16)..(16): bAla
RXRRAFQILYRXRARA

SEQ ID NO: 329 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRYQFLIXRARA

SEQ ID NO: 330 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXRYQFLIRARXRA

SEQ ID NO: 331 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRYQFLIRXRARA

SEQ ID NO: 332 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
  MOD_RES (19)..(19): bAla
RXRRARRXRYQFLIARARA

SEQ ID NO: 333 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXYQFLIXRARA

SEQ ID NO: 334 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXYQFLIRARXRA

SEQ ID NO: 335 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXYQFLIRXRARA

SEQ ID NO: 336 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARRXYQFLIARARA

SEQ ID NO: 337 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXYQFLIXRARA

SEQ ID NO: 338 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXYQFLIRARXRA

SEQ ID NO: 339 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXYQFLIRXRARA

SEQ ID NO: 340 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARXYQFLIARARA

SEQ ID NO: 341 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRAYQFLIRXRARXRA

SEQ ID NO: 342 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRAYQFLIXRARXRA

SEQ ID NO: 343 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRAYQFLIRXRRARA

SEQ ID NO: 344 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRAYQFLIARXRA

SEQ ID NO: 345 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAYQFLIXRRARA

SEQ ID NO: 346 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAYQFLIRRARA

SEQ ID NO: 347 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAYQFLIXRARA

SEQ ID NO: 348 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRAYQFLIRARXRA

SEQ ID NO: 349 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAYQFLIRXRARA

SEQ ID NO: 350 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (13)..(13): bAla
  MOD_RES (15)..(15): bAla
RXRRAYQFLIARARA

SEQ ID NO: 351 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXYQFLIXRARA

SEQ ID NO: 352 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRARXYQFLIRARXRA

SEQ ID NO: 353 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXYQFLIRXRARA

SEQ ID NO: 354 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
  MOD_RES (16)..(16): bAla
RXRARXYQFLIARARA

SEQ ID NO: 355 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRYQFLIXRARA

SEQ ID NO: 356 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXRYQFLIRARXRA

SEQ ID NO: 357 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRYQFLIRXRARA

SEQ ID NO: 358 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARXRYQFLIARARA

SEQ ID NO: 359 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARYQFLIXRARA

SEQ ID NO: 360 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARYQFLIRARXRA

SEQ ID NO: 361 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARYQFLIRXRARA

SEQ ID NO: 362 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
  MOD_RES (16)..(16): bAla
RXRRARYQFLIARARA

SEQ ID NO: 363 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRYQFLIRXRARXRA

SEQ ID NO: 364 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRYQFLIXRARXRA

SEQ ID NO: 365 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRYQFLIRXRRARA

SEQ ID NO: 366 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARRYQFLIARXRA

SEQ ID NO: 367 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRYQFLIXRRARA

SEQ ID NO: 368 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRYQFLIRRARA

SEQ ID NO: 369 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRYQFLIXRARA

SEQ ID NO: 370 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRYQFLIRARXRA

SEQ ID NO: 371 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRYQFLIRXRARA

SEQ ID NO: 372 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARRYQFLIARARA

SEQ ID NO: 373 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRAXYQFLIRXRARXRA

SEQ ID NO: 374 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRAXYQFLIXRARXRA

SEQ ID NO: 375 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRAXYQFLIRXRRARA

SEQ ID NO: 376 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (15)..(15): bAla
RXRAXYQFLIARXRA

SEQ ID NO: 377 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXYQFLIXRRARA

SEQ ID NO: 378 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXYQFLIRRARA

SEQ ID NO: 379 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXYQFLIXRARA

SEQ ID NO: 380 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRAXYQFLIRARXRA

SEQ ID NO: 381 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXYQFLIRXRARA

SEQ ID NO: 382 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (13)..(13): bAla
  MOD_RES (15)..(15): bAla
RXRAXYQFLIARARA

SEQ ID NO: 383 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRIQFLIXRARA

SEQ ID NO: 384 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXRIQFLIRARXRA

SEQ ID NO: 385 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRIQFLIRXRARA

SEQ ID NO: 386 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
  MOD_RES (19)..(19): bAla
RXRRARRXRIQFLIARARA

SEQ ID NO: 387 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXIQFLIXRARA

SEQ ID NO: 388 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXIQFLIRARXRA

SEQ ID NO: 389 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXIQFLIRXRARA

SEQ ID NO: 390 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARRXIQFLIARARA

SEQ ID NO: 391 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXIQFLIXRARA

SEQ ID NO: 392 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXIQFLIRARXRA

SEQ ID NO: 393 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXIQFLIRXRARA

SEQ ID NO: 394 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARXIQFLIARARA

SEQ ID NO: 395 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRAIQFLIRXRARXRA

SEQ ID NO: 396 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRAIQFLIXRARXRA

SEQ ID NO: 397 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRAIQFLIRXRRARA

SEQ ID NO: 398 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRAIQFLIARXRA

SEQ ID NO: 399 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAIQFLIXRRARA

SEQ ID NO: 400 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAIQFLIRRARA

SEQ ID NO: 401 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAIQFLIXRARA

SEQ ID NO: 402 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRAIQFLIRARXRA

SEQ ID NO: 403 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAIQFLIRXRARA

SEQ ID NO: 404 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (13)..(13): bAla
  MOD_RES (15)..(15): bAla
RXRRAIQFLIARARA

SEQ ID NO: 405 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRAXIQFLIRXRARXRA

SEQ ID NO: 406 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRAXIQFLIXRARXRA

SEQ ID NO: 407 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRAXIQFLIRXRRARA

SEQ ID NO: 408 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (15)..(15): bAla
RXRAXIQFLIARXRA

SEQ ID NO: 409 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXIQFLIXRRARA

SEQ ID NO: 410 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXIQFLIRRARA

SEQ ID NO: 411 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXIQFLIXRARA

SEQ ID NO: 412 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRAXIQFLIRARXRA

SEQ ID NO: 413 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXIQFLIRXRARA

SEQ ID NO: 414 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (13)..(13): bAla
  MOD_RES (15)..(15): bAla
RXRAXIQFLIARARA

SEQ ID NO: 415 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXIQFLIXRARA

SEQ ID NO: 416 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRARXIQFLIRARXRA

SEQ ID NO: 417 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXIQFLIRXRARA

SEQ ID NO: 418 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
  MOD_RES (16)..(16): bAla
RXRARXIQFLIARARA

SEQ ID NO: 419 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRIQFLIXRARA

SEQ ID NO: 420 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXRIQFLIRARXRA

SEQ ID NO: 421 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRIQFLIRXRARA

SEQ ID NO: 422 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARXRIQFLIARARA

SEQ ID NO: 423 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARIQFLIXRARA

SEQ ID NO: 424 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARIQFLIRARXRA

SEQ ID NO: 425 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARIQFLIRXRARA

SEQ ID NO: 426 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
  MOD_RES (16)..(16): bAla
RXRRARIQFLIARARA

SEQ ID NO: 427 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRIQFLIRXRARXRA

SEQ ID NO: 428 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRIQFLIXRARXRA

SEQ ID NO: 429 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRIQFLIRXRRARA

SEQ ID NO: 430 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARRIQFLIARXRA

SEQ ID NO: 431 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRIQFLIXRRARA

SEQ ID NO: 432 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRIQFLIRRARA

SEQ ID NO: 433 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRIQFLIXRARA

SEQ ID NO: 434 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRIQFLIRARXRA

SEQ ID NO: 435 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRIQFLIRXRARA

SEQ ID NO: 436 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRARRIQFLIARARA

SEQ ID NO: 437 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXRQFLIXRARA

SEQ ID NO: 438 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXRQFLIRARXRA

SEQ ID NO: 439 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRQFLIRXRARA

SEQ ID NO: 440 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARRXRQFLIARARA

SEQ ID NO: 441 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRXQFLIXRARA

SEQ ID NO: 442 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRXQFLIRARXRA

SEQ ID NO: 443 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXQFLIRXRARA

SEQ ID NO: 444 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARRXQFLIARARA

SEQ ID NO: 445 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARXQFLIXRARA

SEQ ID NO: 446 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARXQFLIRARXRA

SEQ ID NO: 447 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXQFLIRXRARA

SEQ ID NO: 448 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
  MOD_RES (16)..(16): bAla
RXRRARXQFLIARARA

SEQ ID NO: 449 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRAQFLIRXRARXRA

SEQ ID NO: 450 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRAQFLIXRARXRA

SEQ ID NO: 451 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAQFLIRXRRARA

SEQ ID NO: 452 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (10)..(10): bAla
  MOD_RES (14)..(14): bAla
RXRRAQFLIARXRA

SEQ ID NO: 453 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAQFLIXRRARA

SEQ ID NO: 454 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
RXRRAQFLIRRARA

SEQ ID NO: 455 - skipped

SEQ ID NO: 456 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
RXRRAQFLIXRARA

SEQ ID NO: 457 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRAQFLIRARXRA

SEQ ID NO: 458 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAQFLIRXRARA

SEQ ID NO: 459 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (10)..(10): bAla
  MOD_RES (12)..(12): bAla
  MOD_RES (14)..(14): bAla
RXRRAQFLIARARA

SEQ ID NO: 460 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRAXQFLIRXRARXRA

SEQ ID NO: 461 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRAXQFLIXRARXRA

SEQ ID NO: 462 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXQFLIRXRRARA

SEQ ID NO: 463 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (10)..(10): bAla
  MOD_RES (14)..(14): bAla
RXRAXQFLIARXRA

SEQ ID NO: 464 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXQFLIXRRARA

SEQ ID NO: 465 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
RXRAXQFLIRRARA

SEQ ID NO: 466 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
RXRAXQFLIXRARA

SEQ ID NO: 467 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (15)..(15): bAla
RXRAXQFLIRARXRA

SEQ ID NO: 468 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXQFLIRXRARA

SEQ ID NO: 469 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (10)..(10): bAla
  MOD_RES (12)..(12): bAla
  MOD_RES (14)..(14): bAla
RXRAXQFLIARARA

SEQ ID NO: 470 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRARXQFLIXRARA

SEQ ID NO: 471 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRARXQFLIRARXRA

SEQ ID NO: 472 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXQFLIRXRARA

SEQ ID NO: 473 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (13)..(13): bAla
  MOD_RES (15)..(15): bAla
RXRARXQFLIARARA

SEQ ID NO: 474 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXRQFLIXRARA

SEQ ID NO: 475 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXRQFLIRARXRA

SEQ ID NO: 476 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRQFLIRXRARA

SEQ ID NO: 477 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARXRQFLIARARA

SEQ ID NO: 478 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRARQFLIXRARA

SEQ ID NO: 479 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARQFLIRARXRA

SEQ ID NO: 480 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARQFLIRXRARA

SEQ ID NO: 481 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (13)..(13): bAla
  MOD_RES (15)..(15): bAla
RXRRARQFLIARARA

SEQ ID NO: 482 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRQFLIRXRARXRA

SEQ ID NO: 483 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRQFLIXRARXRA

SEQ ID NO: 484 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRQFLIRXRRARA

SEQ ID NO: 485 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARRQFLIARXRA

SEQ ID NO: 486 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRQFLIXRRARA

SEQ ID NO: 487 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARRQFLIRRARA

SEQ ID NO: 488 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARRQFLIXRARA

SEQ ID NO: 489 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARRQFLIRARXRA

SEQ ID NO: 490 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRQFLIRXRARA

SEQ ID NO: 491 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
  MOD_RES (16)..(16): bAla
RXRRARRQFLIARARA

SEQ ID NO: 492 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRXRQFLXRARA

SEQ ID NO: 493 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRXRQFLRARXRA

SEQ ID NO: 494 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXRQFLRXRARA

SEQ ID NO: 495 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARRXRQFLARARA

SEQ ID NO: 496 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARRXQFLXRARA

SEQ ID NO: 497 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARRXQFLRARXRA

SEQ ID NO: 498 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRXQFLRXRARA

SEQ ID NO: 499 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
  MOD_RES (16)..(16): bAla
RXRRARRXQFLARARA

SEQ ID NO: 500 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRARXQFLXRARA

SEQ ID NO: 501 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARXQFLRARXRA

SEQ ID NO: 502 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARXQFLRXRARA

SEQ ID NO: 503 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (13)..(13): bAla
  MOD_RES (15)..(15): bAla
RXRRARXQFLARARA

SEQ ID NO: 504 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRAQFLRXRARXRA

SEQ ID NO: 505 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (9)..(9): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRAQFLXRARXRA

SEQ ID NO: 506 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAQFLRXRRARA

SEQ ID NO: 507 - protein, 13 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (9)..(9): bAla
  MOD_RES (13)..(13): bAla
RXRRAQFLARXRA

SEQ ID NO: 508 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (9)..(9): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
RXRRAQFLXRRARA

SEQ ID NO: 509 - protein, 13 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (13)..(13): bAla
RXRRAQFLRRARA

SEQ ID NO: 510 - protein, 13 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (9)..(9): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (13)..(13): bAla
RXRRAQFLXRARA

SEQ ID NO: 511 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (10)..(10): bAla
  MOD_RES (14)..(14): bAla
RXRRAQFLRARXRA

SEQ ID NO: 512 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
RXRRAQFLRXRARA

SEQ ID NO: 513 - protein, 13 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (9)..(9): bAla
  MOD_RES (11)..(11): bAla
  MOD_RES (13)..(13): bAla
RXRRAQFLARARA

SEQ ID NO: 514 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRAXQFLRXRARXRA

SEQ ID NO: 515 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (9)..(9): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (15)..(15): bAla
RXRAXQFLXRARXRA

SEQ ID NO: 516 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXQFLRXRRARA

SEQ ID NO: 517 - protein, 13 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (9)..(9): bAla
  MOD_RES (13)..(13): bAla
RXRAXQFLARXRA

SEQ ID NO: 518 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (9)..(9): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
RXRAXQFLXRRARA

SEQ ID NO: 519 - protein, 13 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (13)..(13): bAla
RXRAXQFLRRARA

SEQ ID NO: 520 - protein, 13 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (9)..(9): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (13)..(13): bAla
RXRAXQFLXRARA

SEQ ID NO: 521 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (10)..(10): bAla
  MOD_RES (14)..(14): bAla
RXRAXQFLRARXRA

SEQ ID NO: 522 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
RXRAXQFLRXRARA

SEQ ID NO: 523 - protein, 13 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (9)..(9): bAla
  MOD_RES (11)..(11): bAla
  MOD_RES (13)..(13): bAla
RXRAXQFLARARA

SEQ ID NO: 524 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
RXRARXQFLXRARA

SEQ ID NO: 525 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (15)..(15): bAla
RXRARXQFLRARXRA

SEQ ID NO: 526 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRARXQFLRXRARA

SEQ ID NO: 527 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (10)..(10): bAla
  MOD_RES (12)..(12): bAla
  MOD_RES (14)..(14): bAla
RXRARXQFLARARA

SEQ ID NO: 528 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARXRQFLXRARA

SEQ ID NO: 529 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARXRQFLRARXRA

SEQ ID NO: 530 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXRQFLRXRARA

SEQ ID NO: 531 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
  MOD_RES (16)..(16): bAla
RXRRARXRQFLARARA

SEQ ID NO: 532 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (10)..(10): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
RXRRARQFLXRARA

SEQ ID NO: 533 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRARQFLRARXRA

SEQ ID NO: 534 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRARQFLRXRARA

SEQ ID NO: 535 - protein, 14 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (10)..(10): bAla
  MOD_RES (12)..(12): bAla
  MOD_RES (14)..(14): bAla
RXRRARQFLARARA

SEQ ID NO: 536 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRQFLRXRARXRA

SEQ ID NO: 537 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARRQFLXRARXRA

SEQ ID NO: 538 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRQFLRXRRARA

SEQ ID NO: 539 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRARRQFLARXRA

SEQ ID NO: 540 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARRQFLXRRARA

SEQ ID NO: 541 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRARRQFLRRARA

SEQ ID NO: 542 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRARRQFLXRARA

SEQ ID NO: 543 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRARRQFLRARXRA

SEQ ID NO: 544 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARRQFLRXRARA

SEQ ID NO: 545 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (13)..(13): bAla
  MOD_RES (15)..(15): bAla
RXRRARRQFLARARA

SEQ ID NO: 546 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRYRFLIXRARA

SEQ ID NO: 547 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXRYRFLIRARXRA

SEQ ID NO: 548 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRYRFLIRXRARA

SEQ ID NO: 549 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
  MOD_RES (19)..(19): bAla
RXRRARRXRYRFLIARARA

SEQ ID NO: 550 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXYRFLIXRARA

SEQ ID NO: 551 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXYRFLIRARXRA

SEQ ID NO: 552 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXYRFLIRXRARA

SEQ ID NO: 553 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARRXYRFLIARARA

SEQ ID NO: 554 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXYRFLIXRARA

SEQ ID NO: 555 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXYRFLIRARXRA

SEQ ID NO: 556 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXYRFLIRXRARA

SEQ ID NO: 557 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARXYRFLIARARA

SEQ ID NO: 558 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRAYRFLIRXRARXRA

SEQ ID NO: 559 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRAYRFLIXRARXRA

SEQ ID NO: 560 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRAYRFLIRXRRARA

SEQ ID NO: 561 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRAYRFLIARXRA

SEQ ID NO: 562 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAYRFLIXRRARA

SEQ ID NO: 563 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAYRFLIRRARA

SEQ ID NO: 564 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAYRFLIXRARA

SEQ ID NO: 565 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRAYRFLIRARXRA

SEQ ID NO: 566 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAYRFLIRXRARA

SEQ ID NO: 567 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (13)..(13): bAla
  MOD_RES (15)..(15): bAla
RXRRAYRFLIARARA

SEQ ID NO: 568 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRAXYRFLIRXRARXRA

SEQ ID NO: 569 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRAXYRFLIXRARXRA

SEQ ID NO: 570 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRAXYRFLIRXRRARA

SEQ ID NO: 571 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (15)..(15): bAla
RXRAXYRFLIARXRA

SEQ ID NO: 572 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXYRFLIXRRARA

SEQ ID NO: 573 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXYRFLIRRARA

SEQ ID NO: 574 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXYRFLIXRARA

SEQ ID NO: 575 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRAXYRFLIRARXRA

SEQ ID NO: 576 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXYRFLIRXRARA

SEQ ID NO: 577 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (13)..(13): bAla
  MOD_RES (15)..(15): bAla
RXRAXYRFLIARARA

SEQ ID NO: 578 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXYRFLIXRARA

SEQ ID NO: 579 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRARXYRFLIRARXRA

SEQ ID NO: 580 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXYRFLIRXRARA

SEQ ID NO: 581 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
  MOD_RES (16)..(16): bAla
RXRARXYRFLIARARA

SEQ ID NO: 582 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRYRFLIXRARA

SEQ ID NO: 583 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXRYRFLIRARXRA

SEQ ID NO: 584 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRYRFLIRXRARA

SEQ ID NO: 585 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARXRYRFLIARARA

SEQ ID NO: 586 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARYRFLIXRARA

SEQ ID NO: 587 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARYRFLIRARXRA

SEQ ID NO: 588 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARYRFLIRXRARA

SEQ ID NO: 589 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
  MOD_RES (16)..(16): bAla
RXRRARYRFLIARARA

SEQ ID NO: 590 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRYRFLIRXRARXRA

SEQ ID NO: 591 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRYRFLIXRARXRA

SEQ ID NO: 592 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRYRFLIRXRRARA

SEQ ID NO: 593 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARRYRFLIARXRA

SEQ ID NO: 594 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRYRFLIXRRARA

SEQ ID NO: 595 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRYRFLIRRARA

SEQ ID NO: 596 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRYRFLIXRARA

SEQ ID NO: 597 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRYRFLIRARXRA

SEQ ID NO: 598 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRYRFLIRXRARA

SEQ ID NO: 599 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARRYRFLIARARA

SEQ ID NO: 600 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRFQILYXRARA

SEQ ID NO: 601 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXRFQILYRARXRA

SEQ ID NO: 602 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRFQILYRXRARA

SEQ ID NO: 603 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
  MOD_RES (19)..(19): bAla
RXRRARRXRFQILYARARA

SEQ ID NO: 604 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXFQILYXRARA

SEQ ID NO: 605 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXFQILYRARXRA

SEQ ID NO: 606 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXFQILYRXRARA

SEQ ID NO: 607 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARRXFQILYARARA

SEQ ID NO: 608 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXFQILYXRARA

SEQ ID NO: 609 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXFQILYRARXRA

SEQ ID NO: 610 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXFQILYRXRARA

SEQ ID NO: 611 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARXFQILYARARA

SEQ ID NO: 612 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRAFQILYRXRARXRA

SEQ ID NO: 613 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRAFQILYXRARXRA

SEQ ID NO: 614 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRAFQILYRXRRARA

SEQ ID NO: 615 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRAFQILYARXRA

SEQ ID NO: 616 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAFQILYXRRARA

SEQ ID NO: 617 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAFQILYRRARA

SEQ ID NO: 618 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAFQILYXRARA

SEQ ID NO: 619 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRAFQILYRARXRA

SEQ ID NO: 620 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAFQILYRXRARA

SEQ ID NO: 621 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (13)..(13): bAla
  MOD_RES (15)..(15): bAla
RXRRAFQILYARARA

SEQ ID NO: 622 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRAXFQILYRXRARXRA

SEQ ID NO: 623 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRAXFQILYXRARXRA

SEQ ID NO: 624 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRAXFQILYRXRRARA

SEQ ID NO: 625 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (15)..(15): bAla
RXRAXFQILYARXRA

SEQ ID NO: 626 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXFQILYXRRARA

SEQ ID NO: 627 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXFQILYRRARA

SEQ ID NO: 628 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXFQILYXRARA

SEQ ID NO: 629 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRAXFQILYRARXRA

SEQ ID NO: 630 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXFQILYRXRARA

SEQ ID NO: 631 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (13)..(13): bAla
  MOD_RES (15)..(15): bAla
RXRAXFQILYARARA

SEQ ID NO: 632 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXFQILYXRARA

SEQ ID NO: 633 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRARXFQILYRARXRA

SEQ ID NO: 634 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXFQILYRXRARA

SEQ ID NO: 635 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
  MOD_RES (16)..(16): bAla
RXRARXFQILYARARA

SEQ ID NO: 636 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRFQILYXRARA

SEQ ID NO: 637 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXRFQILYRARXRA

SEQ ID NO: 638 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRFQILYRXRARA

SEQ ID NO: 639 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARXRFQILYARARA

SEQ ID NO: 640 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARFQILYXRARA

SEQ ID NO: 641 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARFQILYRARXRA

SEQ ID NO: 642 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARFQILYRXRARA

SEQ ID NO: 643 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
  MOD_RES (16)..(16): bAla
RXRRARFQILYARARA

SEQ ID NO: 644 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRFQILYRXRARXRA

SEQ ID NO: 645 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRFQILYXRARXRA

SEQ ID NO: 646 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRFQILYRXRRARA

SEQ ID NO: 647 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARRFQILYARXRA

SEQ ID NO: 648 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRFQILYXRRARA

SEQ ID NO: 649 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRFQILYRRARA

SEQ ID NO: 650 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRFQILYXRARA

SEQ ID NO: 651 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRFQILYRARXRA

SEQ ID NO: 652 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRFQILYRXRARA

SEQ ID NO: 653 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARRFQILYARARA

SEQ ID NO: 654 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRYRFRLIXRARA

SEQ ID NO: 655 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRXRYRFRLIRARXRA

SEQ ID NO: 656 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (19)..(19): bAla
  MOD_RES (21)..(21): bAla
RXRRARRXRYRFRLIRXRARA

SEQ ID NO: 657 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
  MOD_RES (20)..(20): bAla
RXRRARRXRYRFRLIARARA

SEQ ID NO: 658 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXYRFRLIXRARA

SEQ ID NO: 659 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXYRFRLIRARXRA

SEQ ID NO: 660 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXYRFRLIRXRARA

SEQ ID NO: 661 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
  MOD_RES (19)..(19): bAla
RXRRARRXYRFRLIARARA

SEQ ID NO: 662 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXYRFRLIXRARA

SEQ ID NO: 663 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXYRFRLIRARXRA

SEQ ID NO: 664 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXYRFRLIRXRARA

SEQ ID NO: 665 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARXYRFRLIARARA

SEQ ID NO: 666 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRAYRFRLIRXRARXRA

SEQ ID NO: 667 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRAYRFRLIXRARXRA

SEQ ID NO: 668 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRAYRFRLIRXRRARA

SEQ ID NO: 669 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRAYRFRLIARXRA

SEQ ID NO: 670 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRAYRFRLIXRRARA

SEQ ID NO: 671 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAYRFRLIRRARA

SEQ ID NO: 672 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAYRFRLIXRARA

SEQ ID NO: 673 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRAYRFRLIRARXRA

SEQ ID NO: 674 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRAYRFRLIRXRARA

SEQ ID NO: 675 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
  MOD_RES (16)..(16): bAla
RXRRAYRFRLIARARA

SEQ ID NO: 676 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (19)..(19): bAla
RXRAXYRFRLIRXRARXRA

SEQ ID NO: 677 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRAXYRFRLIXRARXRA

SEQ ID NO: 678 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (16)..(16): bAla
  MOD_RES (18)..(18): bAla
RXRAXYRFRLIRXRRARA

SEQ ID NO: 679 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRAXYRFRLIARXRA

SEQ ID NO: 680 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRAXYRFRLIXRRARA

SEQ ID NO: 681 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXYRFRLIRRARA

SEQ ID NO: 682 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXYRFRLIXRARA

SEQ ID NO: 683 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRAXYRFRLIRARXRA

SEQ ID NO: 684 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRAXYRFRLIRXRARA

SEQ ID NO: 685 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
  MOD_RES (16)..(16): bAla
RXRAXYRFRLIARARA

SEQ ID NO: 686 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXYRFRLIXRARA

SEQ ID NO: 687 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRARXYRFRLIRARXRA

SEQ ID NO: 688 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (16)..(16): bAla
  MOD_RES (18)..(18): bAla
RXRARXYRFRLIRXRARA

SEQ ID NO: 689 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
  MOD_RES (17)..(17): bAla
RXRARXYRFRLIARARA

SEQ ID NO: 690 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRYRFRLIXRARA

SEQ ID NO: 691 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARXRYRFRLIRARXRA

SEQ ID NO: 692 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARXRYRFRLIRXRARA

SEQ ID NO: 693 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
  MOD_RES (19)..(19): bAla
RXRRARXRYRFRLIARARA

SEQ ID NO: 694 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARYRFRLIXRARA

SEQ ID NO: 695 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARYRFRLIRARXRA

SEQ ID NO: 696 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARYRFRLIRXRARA

SEQ ID NO: 697 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARYRFRLIARARA

SEQ ID NO: 698 - protein, 21 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  VARIANT (19)..(19): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (21)..(21): bAla
RXRRARRYRFRLIRXRARXRA

SEQ ID NO: 699 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRYRFRLIXRARXRA

SEQ ID NO: 700 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRYRFRLIRXRRARA

SEQ ID NO: 701 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRYRFRLIARXRA

SEQ ID NO: 702 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRYRFRLIXRRARA

SEQ ID NO: 703 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRYRFRLIRRARA

SEQ ID NO: 704 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRYRFRLIXRARA

SEQ ID NO: 705 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRYRFRLIRARXRA

SEQ ID NO: 706 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRYRFRLIRXRARA

SEQ ID NO: 707 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARRYRFRLIARARA

SEQ ID NO: 708 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXRILFRYXRARA

SEQ ID NO: 709 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRXRILFRYRARXRA

SEQ ID NO: 710 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (18)..(18): bAla
  MOD_RES (20)..(20): bAla
RXRRARRXRILFRYRXRARA

SEQ ID NO: 711 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
  MOD_RES (19)..(19): bAla
RXRRARRXRILFRYARARA

SEQ ID NO: 712 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRXILFRYXRARA

SEQ ID NO: 713 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRXILFRYRARXRA

SEQ ID NO: 714 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRXILFRYRXRARA

SEQ ID NO: 715 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (8)..(8): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARRXILFRYARARA

SEQ ID NO: 716 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARXILFRYXRARA

SEQ ID NO: 717 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARXILFRYRARXRA

SEQ ID NO: 718 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXILFRYRXRARA

SEQ ID NO: 719 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARXILFRYARARA

SEQ ID NO: 720 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRAILFRYRXRARXRA

SEQ ID NO: 721 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRAILFRYXRARXRA

SEQ ID NO: 722 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRAILFRYRXRRARA

SEQ ID NO: 723 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (15)..(15): bAla
RXRRAILFRYARXRA

SEQ ID NO: 724 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAILFRYXRRARA

SEQ ID NO: 725 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAILFRYRRARA

SEQ ID NO: 726 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
RXRRAILFRYXRARA

SEQ ID NO: 727 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (16)..(16): bAla
RXRRAILFRYRARXRA

SEQ ID NO: 728 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRAILFRYRXRARA

SEQ ID NO: 729 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (11)..(11): bAla
  MOD_RES (13)..(13): bAla
  MOD_RES (15)..(15): bAla
RXRRAILFRYARARA

SEQ ID NO: 730 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (18)..(18): bAla
RXRAXILFRYRXRARXRA

SEQ ID NO: 731 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRAXILFRYXRARXRA

SEQ ID NO: 732 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRAXILFRYRXRRARA

SEQ ID NO: 733 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (15)..(15): bAla
RXRAXILFRYARXRA

SEQ ID NO: 734 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXILFRYXRRARA

SEQ ID NO: 735 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXILFRYRRARA

SEQ ID NO: 736 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (11)..(11): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (15)..(15): bAla
RXRAXILFRYXRARA

SEQ ID NO: 737 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (16)..(16): bAla
RXRAXILFRYRARXRA

SEQ ID NO: 738 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRAXILFRYRXRARA

SEQ ID NO: 739 - protein, 15 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (5)..(5): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (11)..(11): bAla
  MOD_RES (13)..(13): bAla
  MOD_RES (15)..(15): bAla
RXRAXILFRYARARA

SEQ ID NO: 740 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (14)..(14): bAla
  MOD_RES (16)..(16): bAla
RXRARXILFRYXRARA

SEQ ID NO: 741 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (13)..(13): bAla
  MOD_RES (17)..(17): bAla
RXRARXILFRYRARXRA

SEQ ID NO: 742 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (15)..(15): bAla
  MOD_RES (17)..(17): bAla
RXRARXILFRYRXRARA

SEQ ID NO: 743 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (6)..(6): Xaa is any of aminohexanoic acid, aminobutyric acid, aminocaprylic acid, beta-alanyl, p-aminobenzoyl, isonipecotyl, or Aib
  MOD_RES (4)..(4): bAla
  MOD_RES (12)..(12): bAla
  MOD_RES (14)..(14): bAla
  MOD_RES (16)..(16): bAla
RXRARXILFRYARARA

SEQ ID NO: 744 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARXRILFRYXRARA

SEQ ID NO: 745 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARXRILFRYRARXRA

SEQ ID NO: 746 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARXRILFRYRXRARA

SEQ ID NO: 747 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (7)..(7): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
  MOD_RES (18)..(18): bAla
RXRRARXRILFRYARARA

SEQ ID NO: 748 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (12)..(12): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (16)..(16): bAla
RXRRARILFRYXRARA

SEQ ID NO: 749 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARILFRYRARXRA

SEQ ID NO: 750 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARILFRYRXRARA

SEQ ID NO: 751 - protein, 16 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (12)..(12): bAla
  MOD_RES (14)..(14): bAla
  MOD_RES (16)..(16): bAla
RXRRARILFRYARARA

SEQ ID NO: 752 - protein, 20 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  VARIANT (18)..(18): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (20)..(20): bAla
RXRRARRILFRYRXRARXRA

SEQ ID NO: 753 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  VARIANT (17)..(17): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (19)..(19): bAla
RXRRARRILFRYXRARXRA

SEQ ID NO: 754 - protein, 19 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (17)..(17): bAla
  MOD_RES (19)..(19): bAla
RXRRARRILFRYRXRRARA

SEQ ID NO: 755 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (15)..(15): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (17)..(17): bAla
RXRRARRILFRYARXRA

SEQ ID NO: 756 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRILFRYXRRARA

SEQ ID NO: 757 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRILFRYRRARA

SEQ ID NO: 758 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (13)..(13): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (15)..(15): bAla
  MOD_RES (17)..(17): bAla
RXRRARRILFRYXRARA

SEQ ID NO: 759 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (16)..(16): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (14)..(14): bAla
  MOD_RES (18)..(18): bAla
RXRRARRILFRYRARXRA

SEQ ID NO: 760 - protein, 18 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  VARIANT (14)..(14): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (16)..(16): bAla
  MOD_RES (18)..(18): bAla
RXRRARRILFRYRXRARA

SEQ ID NO: 761 - protein, 17 aa, Artificial sequence
  Synthetic sequence: Domain 1-3 peptide sequence
  VARIANT (2)..(2): Xaa is any of aminohexanoic acid, aminobutyric acid, aminocaprylic acid, beta-alanyl, p-aminobenzoyl, isonipecotyl, or Aib
  MOD_RES (5)..(5): bAla
  MOD_RES (13)..(13): bAla
  MOD_RES (15)..(15): bAla
  MOD_RES (17)..(17): bAla
RXRRARRILFRYARARA

SEQ ID NO: 762 - protein, 9 aa, Artificial sequence
  Synthetic sequence: Domain 1 sequence
  SITE (2)..(2): Xaa is aminohexanoic acid
  VARIANT (4)..(9): In an embodiment, Xaa4 - 9 is Arg - Ala - Arg - Arg - Xaa - Arg (SEQ ID NO: 763) wherein Xaa is aminohexanoic acid and Ala is bAla
  VARIANT (4)..(9): In an embodiment, Xaa 9 is absent and Xaa4 - 8 is Arg - Ala - Arg - Arg - Xaa (SEQ ID NO: 764) wherein Xaa is aminohexanoic acid and Ala is bAla.
  VARIANT (4)..(9): In an embodiment, Xaa8 - 9 is absent and Xaa4 - 7 is Arg - Ala - Arg -  Xaa (SEQ ID NO: 765) wherein Xaa is aminohexanoic acid and Ala is bAla.
  VARIANT (4)..(9): In an embodiment, Xaa 9 is absent and Xaa4 - 8 is Arg - Ala - Arg -  Xaa - Arg  (SEQ ID NO: 766) wherein Xaa is aminohexanoic acid and Ala is bAla.
  VARIANT (4)..(9): In an embodiment, Xaa7 - 9 is absent and Xaa4 - 6 is Ala - Arg - Xaa (SEQ ID NO: 767) wherein Xaa is aminohexanoic acid and Ala is bAla. In an embodiment, Xaa7 - 9 is absent and Xaa4 - 6 is Arg -Ala - Arg (SEQ ID NO: 769) wherein Ala is bAla.
  VARIANT (4)..(9): In an embodiment, Xaa6 - 9 is absent and Xaa4 - 5 is Ala - Xaa (SEQ ID NO: 768) wherein Xaa is aminohexanoic acid and Ala is bAla. In an embodiment, Xaa6 - 9 is absent and Xaa4 - 5 is Arg -Ala (SEQ ID NO: 770) wherein Ala is bAla.
  VARIANT (4)..(9): In an embodiment, Xaa8 - 9 is absent and Xaa4 - 7 is Arg - Ala - Arg - Arg (SEQ ID NO: 771) wherein Ala is bAla.
RXRXXXXXX

SEQ ID NO: 763 - protein, 6 aa, Artificial sequence
  Synthetic sequence: Domain 1 sequence
  MOD_RES (2)..(2): bAla
  SITE (5)..(5): Xaa is aminohexanoic acid
RARRXR

SEQ ID NO: 764 - protein, 5 aa, Artificial sequence
  Synthetic sequence: Domain 1 sequence
  MOD_RES (2)..(2): bAla
  SITE (5)..(5): Xaa is aminohexanoic acid
RARRX

SEQ ID NO: 765 - protein, 4 aa, Artificial sequence
  Synthetic sequence: Domain 1 sequence
  MOD_RES (2)..(2): bAla
  SITE (4)..(4): Xaa is aminohexanoic acid
RARX

SEQ ID NO: 766 - protein, 5 aa, Artificial sequence
  Synthetic sequence: Domain 1 sequence
  MOD_RES (2)..(2): bAla
  SITE (4)..(4): Xaa is aminohexanoic acid
RARXR

SEQ ID NO: 767 - protein, 3 aa, Artificial sequence
  Synthetic sequence: Domain 1 sequence
  MOD_RES (1)..(1): bAla
  SITE (3)..(3): Xaa is aminohexanoic acid
ARX

SEQ ID NO: 768 - protein, 2 aa, Artificial sequence
  Synthetic sequence: Domain 1 sequence
  MOD_RES (1)..(1): bAla
  SITE (2)..(2): Xaa is aminohexanoic acid
AX

SEQ ID NO: 769 - protein, 3 aa, Artificial sequence
  Synthetic sequence: Domain 1 sequence
  MOD_RES (2)..(2): bAla
RAR

SEQ ID NO: 770 - protein, 2 aa, Artificial sequence
  Synthetic sequence: Domain 1 sequence
  MOD_RES (2)..(2): bAla
RA

SEQ ID NO: 771 - protein, 4 aa, Artificial sequence
  Synthetic sequence: Domain 1 sequence
  MOD_RES (2)..(2): bAla
RARR

SEQ ID NO: 772 - protein, 8 aa, Artificial sequence
  Synthetic peptide: Domain 3 peptide
  SITE (2)..(2): Xaa is aminohexanoic acid
  MOD_RES (4)..(4): bAla
  SITE (6)..(6): Xaa is aminohexanoic acid
  SITE (8)..(8): May optionally comprise a linker at the C-terminal end, which may be one of BCys, XCys, GGCys, BBCys, BXCys or XBCys, X, XX, B, BB, BX, or XB wherein X is Ahx and B is bAla
  MOD_RES (8)..(8): bAla
RXRARXRA

SEQ ID NO: 773 - protein, 7 aa, Artificial sequence
  Synthetic peptide: Domain 3 peptide
  SITE (1)..(1): Xaa is aminohexanoic acid
  MOD_RES (3)..(3): bAla
  SITE (5)..(5): Xaa is aminohexanoic acid
  SITE (7)..(7): May optionally comprise a linker at the C-terminal end, which may be one of BCys, XCys, Cys, GGCys, BBCys, BXCys or XBCys, X, XX, B, BB, BX, or XB wherein X is Ahx and B is bAla
  MOD_RES (7)..(7): bAla
XRARXRA

SEQ ID NO: 774 - protein, 7 aa, Artificial sequence
  Synthetic peptide: Domain 3 peptide
  SITE (2)..(2): Xaa is aminohexanoic acid
  MOD_RES (5)..(5): bAla
  SITE (7)..(7): May optionally comprise a linker at the C-terminal end, which may be one of BCys, XCys, Cys, GGCys, BBCys, BXCys or XBCys, X, XX, B, BB, BX, or XB wherein X is Ahx and B is bAla
  MOD_RES (7)..(7): bAla
RXRRARA

SEQ ID NO: 775 - protein, 5 aa, Artificial sequence
  Synthetic peptide: Domain 3 peptide
  MOD_RES (1)..(1): bAla
  SITE (3)..(3): Xaa is aminohexanoic acid
  SITE (5)..(5): May optionally comprise a linker at the C-terminal end, which may be one of BCys, XCys, Cys, GGCys, BBCys, BXCys or XBCys, X, XX, B, BB, BX, or XB wherein X is Ahx and B is bAla
  MOD_RES (5)..(5): bAla
ARXRA

SEQ ID NO: 776 - protein, 6 aa, Artificial sequence
  Synthetic peptide: Domain 3 peptide
  SITE (1)..(1): Xaa is aminohexanoic acid
  MOD_RES (4)..(4): bAla
  SITE (6)..(6): May optionally comprise a linker at the C-terminal end, which may be one of BCys, XCys, Cys, GGCys, BBCys, BXCys or XBCys, X, XX, B, BB, BX, or XB wherein X is Ahx and B is bAla
  MOD_RES (6)..(6): bAla
XRRARA

SEQ ID NO: 777 - protein, 5 aa, Artificial sequence
  Synthetic peptide: Domain 3 peptide
  MOD_RES (3)..(3): bAla
  SITE (5)..(5): May optionally comprise a linker at the C-terminal end, which may be one of BCys, XCys, Cys, GGCys, BBCys, BXCys or XBCys, X, XX, B, BB, BX, or XB wherein X is Ahx and B is bAla
  MOD_RES (5)..(5): bAla
RRARA

SEQ ID NO: 778 - protein, 5 aa, Artificial sequence
  Synthetic peptide: Domain 3 peptide
  SITE (1)..(1): Xaa is aminohexanoic acid
  MOD_RES (3)..(3): bAla
  SITE (5)..(5): May optionally comprise a linker at the C-terminal end, which may be one of BCys, XCys, Cys, GGCys, BBCys, BXCys or XBCys, X, XX, B, BB, BX, or XB wherein X is Ahx and B is bAla
  MOD_RES (5)..(5): bAla
XRARA

SEQ ID NO: 779 - protein, 6 aa, Artificial sequence
  Synthetic peptide: Domain 3 peptide
  MOD_RES (2)..(2): bAla
  SITE (4)..(4): Xaa is aminohexanoic acid
  SITE (6)..(6): May optionally comprise a linker at the C-terminal end, which may be one of BCys, XCys, Cys, GGCys, BBCys, BXCys or XBCys, X, XX, B, BB, BX, or XB wherein X is Ahx and B is bAla
  MOD_RES (6)..(6): bAla
RARXRA

SEQ ID NO: 780 - protein, 6 aa, Artificial sequence
  Synthetic peptide: Domain 3 peptide
  SITE (2)..(2): Xaa is aminohexanoic acid
  MOD_RES (4)..(4): bAla
  SITE (6)..(6): May optionally comprise a linker at the C-terminal end, which may be one of BCys, XCys, Cys, GGCys, BBCys, BXCys or XBCys, X, XX, B, BB, BX, or XB wherein X is Ahx and B is bAla
  MOD_RES (6)..(6): bAla
RXRARA

SEQ ID NO: 781 - protein, 5 aa, Artificial sequence
  Synthetic peptide: Domain 3 peptide
  MOD_RES (1)..(1): bAla
  MOD_RES (3)..(3): bAla
  SITE (5)..(5): May optionally comprise a linker at the C-terminal end, which may be one of BCys, XCys, Cys, GGCys, BBCys, BXCys or XBCys, X, XX, B, BB, BX, or XB wherein X is Ahx and B is bAla
  MOD_RES (5)..(5): bAla
ARARA

SEQ ID NO: 782 - protein, 9 aa, Artificial sequence
  Synthetic peptide: Domain 1 peptide
  SITE (2)..(2): Xaa is aminohexanoic acid
  MOD_RES (5)..(5): bAla
  SITE (8)..(8): Xaa is aminohexanoic acid
RXRRARRXR

SEQ ID NO: 783 - protein, 8 aa, Artificial sequence
  Synthetic peptide: Domain 1 peptide
  SITE (2)..(2): Xaa is aminohexanoic acid
  MOD_RES (5)..(5): bAla
  SITE (8)..(8): Xaa is aminohexanoic acid
RXRRARRX

SEQ ID NO: 784 - protein, 7 aa, Artificial sequence
  Synthetic peptide: Domain 1 peptide
  SITE (2)..(2): Xaa is aminohexanoic acid
  MOD_RES (5)..(5): bAla
  SITE (7)..(7): Xaa is aminohexanoic acid
RXRRARX

SEQ ID NO: 785 - protein, 6 aa, Artificial sequence
  Synthetic peptide: Domain 1 peptide
  SITE (2)..(2): Xaa is aminohexanoic acid
  MOD_RES (4): bAla
  SITE (6)..(6): Xaa is aminohexanoic acid
RXRARX

SEQ ID NO: 786 - protein, 8 aa, Artificial sequence
  Synthetic peptide: Domain 1 peptide
  SITE (2)..(2): Xaa is aminohexanoic acid
  MOD_RES (5)..(5): bAla
  SITE (7)..(7): Xaa is aminohexanoic acid
RXRRARXR

SEQ ID NO: 787 - protein, 6 aa, Artificial sequence
  Synthetic peptide: Domain 1 peptide
  SITE (2)..(2): Xaa is aminohexanoic acid
  MOD_RES (5)..(5): bAla
RXRRAR

SEQ ID NO: 788 - protein, 5 aa, Artificial sequence
  Synthetic peptide: Domain 1 peptide
  SITE (2)..(2): Xaa is aminohexanoic acid
  MOD_RES (5)..(5): bAla
RXRRA

SEQ ID NO: 789 - protein, 7 aa, Artificial sequence
  Synthetic peptide: Domain 1 peptide
  SITE (2)..(2): Xaa is aminohexanoic acid
  MOD_RES (5)..(5): bAla
RXRRARR

SEQ ID NO: 790 - protein, 5 aa, Artificial sequence
  Synthetic peptide: Domain 1 peptide
  SITE (2)..(2): Xaa is aminohexanoic acid
  MOD_RES (4): bAla
  SITE (5)..(5): Xaa is aminohexanoic acid
RXRAX

SEQ ID NO: 791 - protein, 25 aa, Artificial sequence
  Synthetic peptide
  VARIANT (1)..(9): In an embodiment, Xaa1-9 is Arg - Xaa - Arg - Arg - Ala - Arg - Arg - Xaa - Arg (SEQ ID NO: 782) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Arg - Xaa (SEQ ID NO: 783) wherein Xaa is aminohexanoic acid and Ala is bAla
  VARIANT (1)..(9): In an embodiment, Xaa1 - 2 is absent and Xaa3-9 is Arg - Xaa - Arg - Arg - Ala - Arg  - Xaa (SEQ ID NO: 784) wherein Xaa is aminohexanoic acid and Ala is bAla
  VARIANT (1)..(9): In an embodiment, Xaa1 - 3 is absent and Xaa4 - 9 is Arg - Xaa - Arg - Ala - Arg  - Xaa (SEQ ID NO: 785) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Xaa - Arg (SEQ ID NO: 786) wherein Xaa is aminohexanoic acid and Ala is bAla
  VARIANT (1)..(9): In an embodiment, Xaa1 - 3 is absent and Xaa4 - 9 is Arg - Xaa - Arg - Arg - Ala - Arg (SEQ ID NO: 787) wherein Xaa is aminohexanoic acid and Ala is bAla
  VARIANT (1)..(9): In an embodiment, Xaa1 - 4 is absent and Xaa5 - 9 is Arg - Xaa - Arg - Arg - Ala -  (SEQ ID NO: 788) wherein Xaa is aminohexanoic acid and Ala is bAla
  VARIANT (1)..(9): In an embodiment, Xaa1 - 2 is absent and Xaa3 - 9 is Arg - Xaa - Arg - Arg - Ala - Arg  - Arg (SEQ ID NO: 789) wherein Xaa is aminohexanoic acid and Ala is bAla
  VARIANT (15)..(22): In an embodiment, Xaa15-22 is Arg - Xaa - Arg - Ala - Arg - Xaa - Arg - Ala (SEQ ID NO: 772) wherein Xaa is aminohexanoic acid and Ala is bAla
  VARIANT (15)..(22): In an embodiment, Xaa15 is absent and Xaa16-22 is Xaa - Arg - Ala - Arg - Xaa - Arg - Ala (SEQ ID NO: 773) wherein Xaa is aminohexanoic acid and Ala is bAla
  VARIANT (15)..(22): In an embodiment, Xaa15 is absent and Xaa16-22 is Arg - Xaa - Arg - Arg - Ala -  Arg - Ala (SEQ ID NO: 774) wherein Xaa is aminohexanoic acid and Ala is bAla
  VARIANT (15)..(22): In an embodiment, Xaa15-17 is absent and Xaa18-22 is Ala - Arg - Xaa - Arg - Ala (SEQ ID NO: 775) wherein Xaa is aminohexanoic acid and Ala is bAla
  VARIANT (15)..(22): In an embodiment, Xaa15-16 is absent and Xaa17-22 is Xaa - Arg - Arg - Ala -  Arg - Ala (SEQ ID NO: 776) wherein Xaa is aminohexanoic acid and Ala is bAla
  VARIANT (15)..(22): In an embodiment, Xaa15-17 is absent and Xaa18-22 is Arg - Arg - Ala -  Arg - Ala (SEQ ID NO: 777) wherein Xaa is aminohexanoic acid and Ala is bAla
  VARIANT (15)..(22): In an embodiment, Xaa15-17 is absent and Xaa18-22 is Xaa - Arg - Ala -  Arg - Ala (SEQ ID NO: 778) wherein Xaa is aminohexanoic acid and Ala is bAla
  VARIANT (15)..(22): In an embodiment, Xaa15-16 is absent and Xaa17-22 is Arg - Ala - Arg - Xaa - Arg - Ala (SEQ ID NO: 779) wherein Xaa is aminohexanoic acid and Ala is bAla
  VARIANT (15)..(22): In an embodiment, Xaa15-16 is absent and Xaa17-22 is Arg - Xaa - Arg - Ala - Arg - Ala (SEQ ID NO: 780) wherein Xaa is aminohexanoic acid and Ala is bAla
  VARIANT (15)..(22): In an embodiment, Xaa15-17 is absent and Xaa18 - 22 is Ala - Arg - Ala - Arg - Ala (SEQ ID NO: 781) wherein Xaa is aminohexanoic acid and Ala is bAla
  VARIANT (23)..(25): Optional linker, in which if present up to 2 Xaa may be present or absent. If present, linker may be one of BCys, XCys, Cys, GGCys, BBCys, BXCys or XBCys, X, XX, B, BB, BX, or XB wherein X is Ahx and B is bAla
XXXXXXXXXYQFLIXXXXXXXXXXX

SEQ ID NO: 792 - protein, 25 aa, Artificial sequence
  Synthetic peptide
  VARIANT (1)..(9): In an embodiment, Xaa1-9 is Arg - Xaa - Arg - Arg - Ala - Arg - Arg - Xaa - Arg (SEQ ID NO: 782) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Arg - Xaa (SEQ ID NO: 783) wherein Xaa is aminohexanoic acid and Ala is bAla
  VARIANT (1)..(9): In an embodiment, Xaa1 - 2 is absent and Xaa3-9 is Arg - Xaa - Arg - Arg - Ala - Arg  - Xaa (SEQ ID NO: 784) wherein Xaa is aminohexanoic acid and Ala is bAla
  VARIANT (1)..(9): In an embodiment, Xaa1 - 3 is absent and Xaa4 - 9 is Arg - Xaa - Arg - Ala - Arg  - Xaa (SEQ ID NO: 785) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Xaa - Arg (SEQ ID NO: 786) wherein Xaa is aminohexanoic acid and Ala is bAla
  VARIANT (1)..(9): In an embodiment, Xaa1 - 3 is absent and Xaa4 - 9 is Arg - Xaa - Arg - Arg - Ala - Arg (SEQ ID NO: 787) wherein Xaa is aminohexanoic acid and Ala is bAla
  VARIANT (1)..(9): In an embodiment, Xaa1 - 4 is absent and Xaa5 - 9 is Arg - Xaa - Arg - Arg - Ala -  (SEQ ID NO: 788) wherein Xaa is aminohexanoic acid and Ala is bAla
  VARIANT (1)..(9): In an embodiment, Xaa1 - 2 is absent and Xaa3 - 9 is Arg - Xaa - Arg - Arg - Ala - Arg  - Arg (SEQ ID NO: 789) wherein Xaa is aminohexanoic acid and Ala is bAla
  VARIANT (15)..(22): In an embodiment, Xaa15-22 is Arg - Xaa - Arg - Ala - Arg - Xaa - Arg - Ala (SEQ ID NO: 772) wherein Xaa is aminohexanoic acid and Ala is bAla
  VARIANT (15)..(22): In an embodiment, Xaa15 is absent and Xaa16-22 is Xaa - Arg - Ala - Arg - Xaa - Arg - Ala (SEQ ID NO: 773) wherein Xaa is aminohexanoic acid and Ala is bAla
  VARIANT (15)..(22): In an embodiment, Xaa15 is absent and Xaa16-22 is Arg - Xaa - Arg - Arg - Ala -  Arg - Ala (SEQ ID NO: 774) wherein Xaa is aminohexanoic acid and Ala is bAla
  VARIANT (15)..(22): In an embodiment, Xaa15-17 is absent and Xaa18-22 is Ala - Arg - Xaa - Arg - Ala (SEQ ID NO: 775) wherein Xaa is aminohexanoic acid and Ala is bAla
  VARIANT (15)..(22): In an embodiment, Xaa15-16 is absent and Xaa17-22 is Xaa - Arg - Arg - Ala -  Arg - Ala (SEQ ID NO: 776) wherein Xaa is aminohexanoic acid and Ala is bAla
  VARIANT (15)..(22): In an embodiment, Xaa15-17 is absent and Xaa18-22 is Arg - Arg - Ala -  Arg - Ala (SEQ ID NO: 777) wherein Xaa is aminohexanoic acid and Ala is bAla
  VARIANT (15)..(22): In an embodiment, Xaa15-17 is absent and Xaa18-22 is Xaa - Arg - Ala -  Arg - Ala (SEQ ID NO: 778) wherein Xaa is aminohexanoic acid and Ala is bAla
  VARIANT (15)..(22): In an embodiment, Xaa15-16 is absent and Xaa17-22 is Arg - Ala - Arg - Xaa - Arg - Ala (SEQ ID NO: 779) wherein Xaa is aminohexanoic acid and Ala is bAla
  VARIANT (15)..(22): In an embodiment, Xaa15-16 is absent and Xaa17-22 is Arg - Xaa - Arg - Ala - Arg - Ala (SEQ ID NO: 780) wherein Xaa is aminohexanoic acid and Ala is bAla
  VARIANT (15)..(22): In an embodiment, Xaa15-17 is absent and Xaa18 - 22 is Ala - Arg - Ala - Arg - Ala (SEQ ID NO: 781) wherein Xaa is aminohexanoic acid and Ala is bAla
  VARIANT (23)..(25): Optional linker, in which if present up to 2 Xaa may be present or absent. If present, linker may be one of BCys, XCys, Cys, GGCys, BBCys, BXCys or XBCys, X, XX, B, BB, BX, or XB wherein X is Ahx and B is bAla
XXXXXXXXXIQFLIXXXXXXXXXXX

SEQ ID NO: 793 - protein, 25 aa, Artificial sequence
  Synthetic peptide
  VARIANT (1)..(9): In an embodiment, Xaa1-9 is Arg - Xaa - Arg - Arg - Ala - Arg - Arg - Xaa - Arg (SEQ ID NO: 782) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Arg - Xaa (SEQ ID NO: 783) wherein Xaa is aminohexanoic acid and Ala is bAla
  VARIANT (1)..(9): In an embodiment, Xaa1 - 2 is absent and Xaa3-9 is Arg - Xaa - Arg - Arg - Ala - Arg  - Xaa (SEQ ID NO: 784) wherein Xaa is aminohexanoic acid and Ala is bAla
  VARIANT (1)..(9): In an embodiment, Xaa1 - 3 is absent and Xaa4 - 9 is Arg - Xaa - Arg - Ala - Arg  - Xaa (SEQ ID NO: 785) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Xaa - Arg (SEQ ID NO: 786) wherein Xaa is aminohexanoic acid and Ala is bAla
  VARIANT (1)..(9): In an embodiment, Xaa1 - 3 is absent and Xaa4 - 9 is Arg - Xaa - Arg - Arg - Ala - Arg (SEQ ID NO: 787) wherein Xaa is aminohexanoic acid and Ala is bAla
  VARIANT (1)..(9): In an embodiment, Xaa1 - 4 is absent and Xaa5 - 9 is Arg - Xaa - Arg - Arg - Ala -  (SEQ ID NO: 788) wherein Xaa is aminohexanoic acid and Ala is bAla
  VARIANT (1)..(9): In an embodiment, Xaa1 - 2 is absent and Xaa3 - 9 is Arg - Xaa - Arg - Arg - Ala - Arg  - Arg (SEQ ID NO: 789) wherein Xaa is aminohexanoic acid and Ala is bAla
  VARIANT (15)..(22): In an embodiment, Xaa15-22 is Arg - Xaa - Arg - Ala - Arg - Xaa - Arg - Ala (SEQ ID NO: 772) wherein Xaa is aminohexanoic acid and Ala is bAla
  VARIANT (15)..(22): In an embodiment, Xaa15 is absent and Xaa16-22 is Xaa - Arg - Ala - Arg - Xaa - Arg - Ala (SEQ ID NO: 773) wherein Xaa is aminohexanoic acid and Ala is bAla
  VARIANT (15)..(22): In an embodiment, Xaa15 is absent and Xaa16-22 is Arg - Xaa - Arg - Arg - Ala -  Arg - Ala (SEQ ID NO: 774) wherein Xaa is aminohexanoic acid and Ala is bAla
  VARIANT (15)..(22): In an embodiment, Xaa15-17 is absent and Xaa18-22 is Ala - Arg - Xaa - Arg - Ala (SEQ ID NO: 775) wherein Xaa is aminohexanoic acid and Ala is bAla
  VARIANT (15)..(22): In an embodiment, Xaa15-16 is absent and Xaa17-22 is Xaa - Arg - Arg - Ala -  Arg - Ala (SEQ ID NO: 776) wherein Xaa is aminohexanoic acid and Ala is bAla
  VARIANT (15)..(22): In an embodiment, Xaa15-17 is absent and Xaa18-22 is Arg - Arg - Ala -  Arg - Ala (SEQ ID NO: 777) wherein Xaa is aminohexanoic acid and Ala is bAla
  VARIANT (15)..(22): In an embodiment, Xaa15-17 is absent and Xaa18-22 is Xaa - Arg - Ala -  Arg - Ala (SEQ ID NO: 778) wherein Xaa is aminohexanoic acid and Ala is bAla
  VARIANT (15)..(22): In an embodiment, Xaa15-16 is absent and Xaa17-22 is Arg - Ala - Arg - Xaa - Arg - Ala (SEQ ID NO: 779) wherein Xaa is aminohexanoic acid and Ala is bAla
  VARIANT (15)..(22): In an embodiment, Xaa15-16 is absent and Xaa17-22 is Arg - Xaa - Arg - Ala - Arg - Ala (SEQ ID NO: 780) wherein Xaa is aminohexanoic acid and Ala is bAla
  VARIANT (15)..(22): In an embodiment, Xaa15-17 is absent and Xaa18 - 22 is Ala - Arg - Ala - Arg - Ala (SEQ ID NO: 781) wherein Xaa is aminohexanoic acid and Ala is bAla
  VARIANT (23)..(25): Optional linker, in which if present up to 2 Xaa may be present or absent. If present, linker may be one of BCys, XCys, Cys, GGCys, BBCys, BXCys or XBCys, X, XX, B, BB, BX, or XB wherein X is Ahx and B is bAla
XXXXXXXXXYRFLIXXXXXXXXXXX

SEQ ID NO: 794 - protein, 26 aa, Artificial sequence
  Synthetic peptide
  VARIANT (1)..(9): In an embodiment, Xaa1-9 is Arg - Xaa - Arg - Arg - Ala - Arg - Arg - Xaa - Arg (SEQ ID NO: 782) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Arg - Xaa (SEQ ID NO: 783) wherein Xaa is aminohexanoic acid and Ala is bAla
  VARIANT (1)..(9): In an embodiment, Xaa1 - 2 is absent and Xaa3-9 is Arg - Xaa - Arg - Arg - Ala - Arg  - Xaa (SEQ ID NO: 784) wherein Xaa is aminohexanoic acid and Ala is bAla
  VARIANT (1)..(9): In an embodiment, Xaa1 - 3 is absent and Xaa4 - 9 is Arg - Xaa - Arg - Ala - Arg  - Xaa (SEQ ID NO: 785) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Xaa - Arg (SEQ ID NO: 786) wherein Xaa is aminohexanoic acid and Ala is bAla
  VARIANT (1)..(9): In an embodiment, Xaa1 - 3 is absent and Xaa4 - 9 is Arg - Xaa - Arg - Arg - Ala - Arg (SEQ ID NO: 787) wherein Xaa is aminohexanoic acid and Ala is bAla
  VARIANT (1)..(9): In an embodiment, Xaa1 - 4 is absent and Xaa5 - 9 is Arg - Xaa - Arg - Arg - Ala -  (SEQ ID NO: 788) wherein Xaa is aminohexanoic acid and Ala is bAla
  VARIANT (1)..(9): In an embodiment, Xaa1 - 2 is absent and Xaa3 - 9 is Arg - Xaa - Arg - Arg - Ala - Arg  - Arg (SEQ ID NO: 789) wherein Xaa is aminohexanoic acid and Ala is bAla
  VARIANT (16)..(23): In an embodiment, Xaa16-23 is Arg - Xaa - Arg - Ala - Arg - Xaa - Arg - Ala (SEQ ID NO: 772) wherein Xaa is aminohexanoic acid and Ala is bAla
  VARIANT (16)..(23): In an embodiment, Xaa16 is absent and Xaa17-23 is Xaa - Arg - Ala - Arg - Xaa - Arg - Ala (SEQ ID NO: 773) wherein Xaa is aminohexanoic acid and Ala is bAla
  VARIANT (16)..(23): In an embodiment, Xaa16 is absent and Xaa17-23 is Arg - Xaa - Arg - Arg - Ala -  Arg - Ala (SEQ ID NO: 774) wherein Xaa is aminohexanoic acid and Ala is bAla
  VARIANT (16)..(23): In an embodiment, Xaa16-18 is absent and Xaa19-23 is Ala - Arg - Xaa - Arg - Ala (SEQ ID NO: 775) wherein Xaa is aminohexanoic acid and Ala is bAla
  VARIANT (16)..(23): In an embodiment, Xaa16-17 is absent and Xaa18-23 is Xaa - Arg - Arg - Ala -  Arg - Ala (SEQ ID NO: 776) wherein Xaa is aminohexanoic acid and Ala is bAla
  VARIANT (16)..(23): In an embodiment, Xaa16-18 is absent and Xaa19-23 is Arg - Arg - Ala -  Arg - Ala (SEQ ID NO: 777) wherein Xaa is aminohexanoic acid and Ala is bAla
  VARIANT (16)..(23): In an embodiment, Xaa16-18 is absent and Xaa19-23 is Xaa - Arg - Ala -  Arg - Ala (SEQ ID NO: 778) wherein Xaa is aminohexanoic acid and Ala is bAla
  VARIANT (16)..(23): In an embodiment, Xaa16-17 is absent and Xaa18-23 is Arg - Ala - Arg - Xaa - Arg - Ala (SEQ ID NO: 779) wherein Xaa is aminohexanoic acid and Ala is bAla
  VARIANT (16)..(23): In an embodiment, Xaa16-17 is absent and Xaa18-23 is Arg - Xaa - Arg - Ala - Arg - Ala (SEQ ID NO: 780) wherein Xaa is aminohexanoic acid and Ala is bAla
  VARIANT (16)..(23): In an embodiment, Xaa16-18 is absent and Xaa19 - 23 is Ala - Arg - Ala - Arg - Ala (SEQ ID NO: 781) wherein Xaa is aminohexanoic acid and Ala is bAla
  VARIANT (24)..(26): Optional linker, in which if present up to 2 Xaa may be present or absent. If present, linker may be one of BCys, XCys, Cys, GGCys, BBCys, BXCys or XBCys, X, XX, B, BB, BX, or XB wherein X is Ahx and B is bAla
XXXXXXXXXYRFRLIXXXXXXXXXXX

SEQ ID NO: 795 - protein, 25 aa, Artificial sequence
  Synthetic peptide
  VARIANT (1)..(9): In an embodiment, Xaa1-9 is Arg - Xaa - Arg - Arg - Ala - Arg - Arg - Xaa - Arg (SEQ ID NO: 782) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Arg - Xaa (SEQ ID NO: 783) wherein Xaa is aminohexanoic acid and Ala is bAla
  VARIANT (1)..(9): In an embodiment, Xaa1 - 2 is absent and Xaa3-9 is Arg - Xaa - Arg - Arg - Ala - Arg  - Xaa (SEQ ID NO: 784) wherein Xaa is aminohexanoic acid and Ala is bAla
  VARIANT (1)..(9): In an embodiment, Xaa1 - 3 is absent and Xaa4 - 9 is Arg - Xaa - Arg - Ala - Arg  - Xaa (SEQ ID NO: 785) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Xaa - Arg (SEQ ID NO: 786) wherein Xaa is aminohexanoic acid and Ala is bAla
  VARIANT (1)..(9): In an embodiment, Xaa1 - 3 is absent and Xaa4 - 9 is Arg - Xaa - Arg - Arg - Ala - Arg (SEQ ID NO: 787) wherein Xaa is aminohexanoic acid and Ala is bAla
  VARIANT (1)..(9): In an embodiment, Xaa1 - 4 is absent and Xaa5 - 9 is Arg - Xaa - Arg - Arg - Ala -  (SEQ ID NO: 788) wherein Xaa is aminohexanoic acid and Ala is bAla
  VARIANT (1)..(9): In an embodiment, Xaa1 - 2 is absent and Xaa3 - 9 is Arg - Xaa - Arg - Arg - Ala - Arg  - Arg (SEQ ID NO: 789) wherein Xaa is aminohexanoic acid and Ala is bAla
  VARIANT (15)..(22): In an embodiment, Xaa15-22 is Arg - Xaa - Arg - Ala - Arg - Xaa - Arg - Ala (SEQ ID NO: 772) wherein Xaa is aminohexanoic acid and Ala is bAla
  VARIANT (15)..(22): In an embodiment, Xaa15 is absent and Xaa16-22 is Xaa - Arg - Ala - Arg - Xaa - Arg - Ala (SEQ ID NO: 773) wherein Xaa is aminohexanoic acid and Ala is bAla
  VARIANT (15)..(22): In an embodiment, Xaa15 is absent and Xaa16-22 is Arg - Xaa - Arg - Arg - Ala -  Arg - Ala (SEQ ID NO: 774) wherein Xaa is aminohexanoic acid and Ala is bAla
  VARIANT (15)..(22): In an embodiment, Xaa15-17 is absent and Xaa18-22 is Ala - Arg - Xaa - Arg - Ala (SEQ ID NO: 775) wherein Xaa is aminohexanoic acid and Ala is bAla
  VARIANT (15)..(22): In an embodiment, Xaa15-16 is absent and Xaa17-22 is Xaa - Arg - Arg - Ala -  Arg - Ala (SEQ ID NO: 776) wherein Xaa is aminohexanoic acid and Ala is bAla
  VARIANT (15)..(22): In an embodiment, Xaa15-17 is absent and Xaa18-22 is Arg - Arg - Ala -  Arg - Ala (SEQ ID NO: 777) wherein Xaa is aminohexanoic acid and Ala is bAla
  VARIANT (15)..(22): In an embodiment, Xaa15-17 is absent and Xaa18-22 is Xaa - Arg - Ala -  Arg - Ala (SEQ ID NO: 778) wherein Xaa is aminohexanoic acid and Ala is bAla
  VARIANT (15)..(22): In an embodiment, Xaa15-16 is absent and Xaa17-22 is Arg - Ala - Arg - Xaa - Arg - Ala (SEQ ID NO: 779) wherein Xaa is aminohexanoic acid and Ala is bAla
  VARIANT (15)..(22): In an embodiment, Xaa15-16 is absent and Xaa17-22 is Arg - Xaa - Arg - Ala - Arg - Ala (SEQ ID NO: 780) wherein Xaa is aminohexanoic acid and Ala is bAla
  VARIANT (15)..(22): In an embodiment, Xaa15-17 is absent and Xaa18 - 22 is Ala - Arg - Ala - Arg - Ala (SEQ ID NO: 781) wherein Xaa is aminohexanoic acid and Ala is bAla
  VARIANT (23)..(25): Optional linker, in which if present up to 2 Xaa may be present or absent. If present, linker may be one of BCys, XCys, Cys, GGCys, BBCys, BXCys or XBCys, X, XX, B, BB, BX, or XB wherein X is Ahx and B is bAla
XXXXXXXXXFQILYXXXXXXXXXXX

SEQ ID NO: 796 - protein, 24 aa, Artificial sequence
  Synthetic peptide
  VARIANT (1)..(9): In an embodiment, Xaa1-9 is Arg - Xaa - Arg - Arg - Ala - Arg - Arg - Xaa - Arg (SEQ ID NO: 782) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Arg - Xaa (SEQ ID NO: 783) wherein Xaa is aminohexanoic acid and Ala is bAla
  VARIANT (1)..(9): In an embodiment, Xaa1 - 2 is absent and Xaa3-9 is Arg - Xaa - Arg - Arg - Ala - Arg  - Xaa (SEQ ID NO: 784) wherein Xaa is aminohexanoic acid and Ala is bAla
  VARIANT (1)..(9): In an embodiment, Xaa1 - 3 is absent and Xaa4 - 9 is Arg - Xaa - Arg - Ala - Arg  - Xaa (SEQ ID NO: 785) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Xaa - Arg (SEQ ID NO: 786) wherein Xaa is aminohexanoic acid and Ala is bAla
  VARIANT (1)..(9): In an embodiment, Xaa1 - 3 is absent and Xaa4 - 9 is Arg - Xaa - Arg - Arg - Ala - Arg (SEQ ID NO: 787) wherein Xaa is aminohexanoic acid and Ala is bAla
  VARIANT (1)..(9): In an embodiment, Xaa1 - 4 is absent and Xaa5 - 9 is Arg - Xaa - Arg - Arg - Ala -  (SEQ ID NO: 788) wherein Xaa is aminohexanoic acid and Ala is bAla
  VARIANT (1)..(9): In an embodiment, Xaa1 - 2 is absent and Xaa3 - 9 is Arg - Xaa - Arg - Arg - Ala - Arg  - Arg (SEQ ID NO: 789) wherein Xaa is aminohexanoic acid and Ala is bAla
  VARIANT (14)..(21): In an embodiment, Xaa14-21 is Arg - Xaa - Arg - Ala - Arg - Xaa - Arg - Ala (SEQ ID NO: 772) wherein Xaa is aminohexanoic acid and Ala is bAla
  VARIANT (14)..(21): In an embodiment, Xaa14 is absent and Xaa15-21 is Xaa - Arg - Ala - Arg - Xaa - Arg - Ala (SEQ ID NO: 773) wherein Xaa is aminohexanoic acid and Ala is bAla
  VARIANT (14)..(21): In an embodiment, Xaa14 is absent and Xaa15-21 is Arg - Xaa - Arg - Arg - Ala -  Arg - Ala (SEQ ID NO: 774) wherein Xaa is aminohexanoic acid and Ala is bAla
  VARIANT (14)..(21): In an embodiment, Xaa14-16 is absent and Xaa17-21 is Ala - Arg - Xaa - Arg - Ala (SEQ ID NO: 775) wherein Xaa is aminohexanoic acid and Ala is bAla
  VARIANT (14)..(21): In an embodiment, Xaa14-15 is absent and Xaa16-21 is Xaa - Arg - Arg - Ala -  Arg - Ala (SEQ ID NO: 776) wherein Xaa is aminohexanoic acid and Ala is bAla
  VARIANT (14)..(21): In an embodiment, Xaa14-16 is absent and Xaa17-21 is Arg - Arg - Ala -  Arg - Ala (SEQ ID NO: 777) wherein Xaa is aminohexanoic acid and Ala is bAla
  VARIANT (14)..(21): In an embodiment, Xaa14-16 is absent and Xaa17-21 is Xaa - Arg - Ala -  Arg - Ala (SEQ ID NO: 778) wherein Xaa is aminohexanoic acid and Ala is bAla
  VARIANT (14)..(21): In an embodiment, Xaa14-15 is absent and Xaa16-21 is Arg - Ala - Arg - Xaa - Arg - Ala (SEQ ID NO: 779) wherein Xaa is aminohexanoic acid and Ala is bAla
  VARIANT (14)..(21): In an embodiment, Xaa14-15 is absent and Xaa16-21 is Arg - Xaa - Arg - Ala - Arg - Ala (SEQ ID NO: 780) wherein Xaa is aminohexanoic acid and Ala is bAla
  VARIANT (14)..(21): In an embodiment, Xaa14-16 is absent and Xaa17 - 21 is Ala - Arg - Ala - Arg - Ala (SEQ ID NO: 781) wherein Xaa is aminohexanoic acid and Ala is bAla
  VARIANT (22)..(24): Optional linker, in which if present up to 2 Xaa may be present or absent. If present, linker may be one of BCys, XCys, Cys, GGCys, BBCys, BXCys or XBCys, X, XX, B, BB, BX, or XB wherein X is Ahx and B is bAla
XXXXXXXXXQFLIXXXXXXXXXXX

SEQ ID NO: 797 - protein, 23 aa, Artificial sequence
  Synthetic peptide
  VARIANT (1)..(9): In an embodiment, Xaa1-9 is Arg - Xaa - Arg - Arg - Ala - Arg - Arg - Xaa - Arg (SEQ ID NO: 782) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Arg - Xaa (SEQ ID NO: 783) wherein Xaa is aminohexanoic acid and Ala is bAla
  VARIANT (1)..(9): In an embodiment, Xaa1 - 2 is absent and Xaa3-9 is Arg - Xaa - Arg - Arg - Ala - Arg  - Xaa (SEQ ID NO: 784) wherein Xaa is aminohexanoic acid and Ala is bAla
  VARIANT (1)..(9): In an embodiment, Xaa1 - 3 is absent and Xaa4 - 9 is Arg - Xaa - Arg - Ala - Arg  - Xaa (SEQ ID NO: 785) wherein Xaa is aminohexanoic acid and Ala is bAla
  VARIANT (1)..(9): In an embodiment, Xaa1 is absent and Xaa2-9 is Arg - Xaa - Arg - Arg - Ala - Arg - Xaa - Arg (SEQ ID NO: 786) wherein Xaa is aminohexanoic acid and Ala is bAla
  VARIANT (1)..(9): In an embodiment, Xaa1 - 3 is absent and Xaa4 - 9 is Arg - Xaa - Arg - Arg - Ala - Arg (SEQ ID NO: 787) wherein Xaa is aminohexanoic acid and Ala is bAla
  VARIANT (1)..(9): In an embodiment, Xaa1 - 4 is absent and Xaa5 - 9 is Arg - Xaa - Arg - Arg - Ala -  (SEQ ID NO: 788) wherein Xaa is aminohexanoic acid and Ala is bAla
  VARIANT (1)..(9): In an embodiment, Xaa1 - 2 is absent and Xaa3 - 9 is Arg - Xaa - Arg - Arg - Ala - Arg  - Arg (SEQ ID NO: 789) wherein Xaa is aminohexanoic acid and Ala is bAla
  VARIANT (13)..(20): In an embodiment, Xaa13-20 is Arg - Xaa - Arg - Ala - Arg - Xaa - Arg - Ala (SEQ ID NO: 772) wherein Xaa is aminohexanoic acid and Ala is bAla
  VARIANT (13)..(20): In an embodiment, Xaa13 is absent and Xaa14-20 is Xaa - Arg - Ala - Arg - Xaa - Arg - Ala (SEQ ID NO: 773) wherein Xaa is aminohexanoic acid and Ala is bAla
  VARIANT (13)..(20): In an embodiment, Xaa13 is absent and Xaa14-20 is Arg - Xaa - Arg - Arg - Ala -  Arg - Ala (SEQ ID NO: 774) wherein Xaa is aminohexanoic acid and Ala is bAla
  VARIANT (13)..(20): In an embodiment, Xaa13-15 is absent and Xaa16-20 is Ala - Arg - Xaa - Arg - Ala (SEQ ID NO: 775) wherein Xaa is aminohexanoic acid and Ala is bAla
  VARIANT (13)..(20): In an embodiment, Xaa13-14 is absent and Xaa15-20 is Xaa - Arg - Arg - Ala -  Arg - Ala (SEQ ID NO: 776) wherein Xaa is aminohexanoic acid and Ala is bAla
  VARIANT (13)..(20): In an embodiment, Xaa13-15 is absent and Xaa16-20 is Arg - Arg - Ala -  Arg - Ala (SEQ ID NO: 777) wherein Xaa is aminohexanoic acid and Ala is bAla
  VARIANT (13)..(20): In an embodiment, Xaa13-15 is absent and Xaa16-20 is Xaa - Arg - Ala -  Arg - Ala (SEQ ID NO: 778) wherein Xaa is aminohexanoic acid and Ala is bAla
  VARIANT (13)..(20): In an embodiment, Xaa13-14 is absent and Xaa15-20 is Arg - Ala - Arg - Xaa - Arg - Ala (SEQ ID NO: 779) wherein Xaa is aminohexanoic acid and Ala is bAla
  VARIANT (13)..(20): In an embodiment, Xaa13-14 is absent and Xaa15-20 is Arg - Xaa - Arg - Ala - Arg - Ala (SEQ ID NO: 780) wherein Xaa is aminohexanoic acid and Ala is bAla
  VARIANT (13)..(20): In an embodiment, Xaa13-15 is absent and Xaa16 - 20 is Ala - Arg - Ala - Arg - Ala (SEQ ID NO: 781) wherein Xaa is aminohexanoic acid and Ala is bAla
  VARIANT (21)..(23): Optional linker, in which if present up to 2 Xaa may be present or absent. If present, linker may be one of BCys, XCys, Cys, GGCys, BBCys, BXCys or XBCys, X, XX, B, BB, BX, or XB wherein X is Ahx and B is bAla
XXXXXXXXXQFLXXXXXXXXXXX

SEQ ID NO: 798 - protein, 5 aa, Artificial sequence
  Synthetic peptide
  VARIANT (1)..(1): Xaa is Tyr or Ile
  VARIANT (2)..(2): Xaa is Gln or Arg
XXFLI

SEQ ID NO: 799 - protein, 5 aa, Artificial sequence
  Synthetic peptide
ILFQY

SEQ ID NO: 800 - protein, 4 aa, Artificial sequence
  Synthetic peptide
ILFQ

SEQ ID NO: 801 - protein, 4 aa, Artificial sequence
  Synthetic peptide
ILIQ

SEQ ID NO: 802 - protein, 5 aa, Artificial sequence
  Synthetic peptide
YQFLI

SEQ ID NO: 803 - protein, 5 aa, Artificial sequence
  Synthetic peptide
IQFLI

SEQ ID NO: 804 - protein, 5 aa, Artificial sequence
  Synthetic peptide
YRFLI

SEQ ID NO: 805 - protein, 6 aa, Artificial sequence
  Synthetic peptide
YRFRLI

SEQ ID NO: 806 - protein, 5 aa, Artificial sequence
  Synthetic peptide
FQILY

SEQ ID NO: 807 - protein, 4 aa, Artificial sequence
  Synthetic peptide
QFLI

SEQ ID NO: 808 - protein, 3 aa, Artificial sequence
  Synthetic peptide
QFL

SEQ ID NO: 809 - protein, 23 aa, Artificial sequence
  Synthetic sequence: Pip-5e
  SITE (2)..(2): Xaa is aminohexanoic acid
  MOD_RES (5): bAla
  SITE (8)..(8): Xaa is aminohexanoic acid
  SITE (16)..(16): Xaa is aminohexanoic acid
  MOD_RES (18): bAla
  SITE (20)..(20): Xaa is aminohexanoic acid
  MOD_RES (22): bAla
RXRRARRXRILFQYRXRARXRAC

SEQ ID NO: 810 - protein, 20 aa, Artificial sequence
  Synthetic sequence: B-MSP-PMO
  SITE (2)..(2): Xaa is aminohexanoic acid
  MOD_RES (5)..(5): bAla
  SITE (8)..(8): Xaa is aminohexanoic acid
  MOD_RES (11)..(11): bAla
  SITE (20)..(20): Xaa is aminohexanoic acid
RXRRARRXRRARASSLNIAX

SEQ ID NO: 811 - protein, 5 aa, Artificial sequence
  Synthetic sequence: Domain 2 peptide sequence
ILFRY

SEQ ID NO: 812 - DNA, 20 bp, Artificial sequence
  Synthetic sequence: Forward primer
gccatagcacgagaaaaagc

SEQ ID NO: 813 - DNA, 20 bp, Artificial sequence
  Synthetic sequence: Reverse primer
gcattaacaccctcatttgc

SEQ ID NO: 814 - DNA, 21 bp, Artificial sequence
  Synthetic sequence: Forward primer
gcgctatcaggagacaatgag

SEQ ID NO: 815 - DNA, 26 bp, Artificial sequence
  Synthetic sequence: Reverse primer
gtttttatgtgattctgtaatttccc

SEQ ID NO: 816 - protein, 6 aa, Artificial sequence
  Synthetic sequence
  SITE (1)..(1): Xaa is aminohexanoic acid
XYRFLI

SEQ ID NO: 817 - protein, 6 aa, Artificial sequence
  Synthetic sequence
  SITE (1)..(1): Xaa is aminohexanoic acid
XILFRY

SEQ ID NO: 818 - protein, 8 aa, Artificial sequence
  Synthetic sequence
  SITE (1)..(1): Xaa is aminohexanoic acid
  SITE (8)..(8): Xaa is aminohexanoic acid
XYRFRLIX

The invention claimed is:

1. A peptide, having a primary sequence structure comprised of at least three domains, having the arrangement:

N-terminus [Domain 1]-[Domain 2]-[Domain 3] C-terminus wherein the total number of residues in Domains 1-3 combined is no more than 40, the number of R (Arginine) residues in Domains 1 and 3 combined is at least 5, the number of X residues in Domains 1 and 3 combined is at least 1, the number of B residues in Domains 1 and 3 combined is at least 2, wherein X=aminohexanoic acid and B=betaAlanine, Domain 2 comprises a sequence that contains at least 3 of the amino acids $Z_1Z_2FLI$ [SEQ ID NO:798], where $Z_1$, is Y or I and $Z_2$ is Q or R, and Domain 2 does not contain an N- to C-terminal contiguous primary sequence of ILFQY [SEQ ID NO:799], ILFQ [SEQ ID NO:800] or ILIQ [SEQ ID NO:801].

2. A peptide, having a primary sequence structure comprised of at least three domains, having the arrangement:

N-terminus [Domain 1]-[Domain 2]-[Domain 3] C-terminus in which:

(i) Domain 1 comprises a sequence chosen from:

RXRZ₃     [SEQ ID NO: 762]

where $Z_3$ is selected from one of:

RBRRXR     [SEQ ID NO: 763]

RBRRX     [SEQ ID NO: 764]

RBRX     [SEQ ID NO: 765]

RBRXR     [SEQ ID NO: 766]

BRX     [SEQ ID NO: 767]

BX     [SEQ ID NO: 768]

RBR     [SEQ ID NO: 769]

RB,     [SEQ ID NO: 770]

or

RBRR     [SEQ ID NO: 771]

(ii) Domain 2 comprises a sequence that contains at least 3 of the amino acids $Z_1Z_2FLI$ [SEQ ID NO:798], where $Z_1$, is Y or I and $Z_2$ is Q or R, and wherein Domain 2 does not contain an N- to C-terminal contiguous primary sequence of ILFQY [SEQ ID NO:799], ILFQ [SEQ ID NO:800] or ILIQ [SEQ ID NO:801], (iii) Domain 3 comprises a sequence chosen from:

```
RXRBRXRB                         [SEQ ID NO: 772]

XRBRXRB                          [SEQ ID NO: 773]

RXRRBRB                          [SEQ ID NO: 774]

BRXRB                            [SEQ ID NO: 775]

XRRBRB                           [SEQ ID NO: 776]

RRBRB                            [SEQ ID NO: 777]

XRBRB                            [SEQ ID NO: 778]

RBRXRB                           [SEQ ID NO: 779]

RXRBRB,                          [SEQ ID NO: 780]
or

BRBRB                            [SEQ ID NO: 781]
``` wherein X=aminohexanoic acid, B=betaAlanine.

3. The peptide of claim 2, wherein Domain 2 comprises an N- to C-terminal contiguous primary sequence chosen from YQFLI [SEQ ID NO:802], IQFLI [SEQ ID NO:803], YRFLI [SEQ ID NO:804], YRFRLI [SEQ ID NO:805], FQILY [SEQ ID NO:806], QFLI [SEQ ID NO:807], QFL [SEQ ID NO:808], or ILFRY [SEQ ID NO:811].

4. The peptide of claim 2, wherein Domain 1 comprises or consists of a sequence chosen from:

```
RXRRBRRXR                        [SEQ ID NO: 782]

RXRRBRRX                         [SEQ ID NO: 783]

RXRRBRX                          [SEQ ID NO: 784]

RXRBRX                           [SEQ ID NO: 785]

RXRRBRXR                         [SEQ ID NO: 786]

RXRRBR                           [SEQ ID NO: 787]

RXRRB                            [SEQ ID NO: 788]

RXRRBRR,                         [SEQ ID NO: 789]
or

RXRBX                            [SEQ ID NO: 790]
```

5. The peptide of claim 2, wherein Domain 3 consists of a sequence chosen from:

```
RXRBRXRB                         [SEQ ID NO: 772]

XRBRXRB                          [SEQ ID NO: 773]

RXRRBRB                          [SEQ ID NO: 774]

BRXRB                            [SEQ ID NO: 775]

XRRBRB                           [SEQ ID NO: 776]

RRBRB                            [SEQ ID NO: 777]

XRBRB                            [SEQ ID NO: 778]

RBRXRB                           [SEQ ID NO: 779]

RXRBRB,                          [SEQ ID NO: 780]

BRBRB.                           [SEQ ID NO: 781]
```

6. The peptide of claim 2 wherein Domain 2 has 4 or 5 amino acids.

7. The peptide of claim 2 wherein Domain 2 contains 0, 1, 2 or 3 R residues.

8. The peptide of claim 2 wherein Domain 2 has at least one R residue, Domain 1 has 5 R residues or less, and Domain 3 has 4 R residues or less.

9. The peptide of claim 2 wherein one or more R residues are D-Arginine.

10. The peptide of claim 2 wherein one or more R residues are L-Arginine.

11. The peptide of claim 2 wherein Domains 1 and 3 only contain R, X and B residues.

12. The peptide of claim 2 wherein Domain 1 has any combination of 2 to 6 R residues, 1 to 3 X residues and 1 to 2 B residues and is no more than 10 residues in length and has 0, 1 or 2 residues that are not R, X or B.

13. The peptide of claim 2 wherein Domain 3 has any combination of 2 to 5 R residues, 1 to 3 X residues and 1 to 3 B residues and is no more than 9 residues in length and has 0, 1 or 2 residues that are not R, X or B.

14. The peptide of claim 2 wherein the peptide has a maximum length of 30 residues, including natural amino acids, X and B residues.

15. The peptide of claim 2 wherein Domain 1 has a length of from 4 to 12 residues, Domain 2 has a length of from 3 to 9 residues, and Domain 3 has a length of from 4 to 12 residues, wherein the lengths include natural amino acids, X and B residues.

16. A peptide of claim 2 comprising a sequence having at least 90% sequence identity to one of SEQ ID NOs:2-308 or 317-761 (FIGS. 18, 23 to 30, and 41).

17. A peptide of claim 2 comprising a sequence having at least 90% sequence identity to the sequence of Domains 1 to 3 of one of Pip-6a, Pip-6b, Pip-6e, Pip-6f (SEQ ID NOs:2, 3, 6, or 7).

18. The peptide of claim 2, wherein the peptide further comprises a linker at the C-terminus.

19. The peptide of claim 18 wherein the linker is chosen from BCys, XCys, Cys, GGCys, BBCys, BXCys, XBCys, BX, or XB.

20. The peptide of claim 2, wherein the peptide is chemically conjugated to a cargo molecule.

21. The peptide of claim 20, wherein the conjugation is at the C-terminus of the peptide.

22. The peptide of claim 20, wherein the cargo molecule is chosen from a nucleic acid, peptide nucleic acid (PNA), phosphorodiamidate morpholino oligonucleotide (PMO), locked nucleic acid (LNA), antisense oligonucleotide, short interfering RNA (siRNA), peptide, cyclic peptide, protein, or drug.

23. The peptide of claim 22, wherein the cargo molecule has a molecular weight less than 5,000 Da.

24. The peptide of claim 22, wherein the cargo molecule is a molecule having at least 90% sequence identity to one of PNADMD [SEQ ID NO:309] or PMODMD [SEQ ID NO:310].

25. A pharmaceutical composition or medicament comprising a peptide according to claim 2.

26. The pharmaceutical composition or medicament of claim 25 further comprising a pharmaceutically acceptable diluent, adjuvant or carrier.

27. A method of treatment of a disease in a patient in need of treatment comprising administering a peptide according to claim 2 to the patient, wherein the disease is Duchenne Muscular Dystrophy (DMD).

28. The peptide of claim 2 wherein Domain 2 has at least two R residues, Domain 1 has 5 R residues or less, and Domain 3 has 4 R residues or less.

29. The peptide of claim 2 comprising a sequence chosen from one of SEQ ID NOs: 2-308 or 317-761 (FIGS. 18, 23 to 30, and 41).

30. The peptide of claim 2 comprising the sequence of Domains 1 to 3 of one of Pip-6a, Pip-6b, Pip-6e, Pip-6f (SEQ ID NOs: 2, 3, 6, or 7).

31. The peptide of claim 22, wherein the cargo molecule is PNADMD [SEQ ID NO: 309] or PMODMD [SEQ ID NO: 310].

32. The peptide of claim 2 consisting of a sequence chosen from one of SEQ ID NOs: 2-308 or 317-761 (FIGS. 18, 23 to 30, and 41).

33. The peptide of claim 2 consisting of the sequence of Domains 1 to 3 of one of Pip-6a, Pip-6b, Pip-6e, Pip-6f (SEQ ID NOs: 2, 3, 6, or 7).

34. An isolated nucleic acid encoding a peptide, having a primary sequence structure comprised of at least three domains, having the arrangement:

N-terminus [Domain 1]-[Domain 2]-[Domain 3] C-terminus in which:

(i) Domain 1 comprises a sequence chosen from:

| | |
|---|---|
| RXRZ$_3$ | [SEQ ID NO: 762] | where $Z_3$ is selected from one of:

| | |
|---|---|
| RBRRXR | [SEQ ID NO: 763] |
| RBRRX | [SEQ ID NO: 764] |
| RBRX | [SEQ ID NO: 765] |
| RBRXR | [SEQ ID NO: 766] |
| BRX | [SEQ ID NO: 767] |
| BX | [SEQ ID NO: 768] |
| RBR | [SEQ ID NO: 769] |
| RB, or | [SEQ ID NO: 770] |
| RBRR | [SEQ ID NO: 771] |

(ii) Domain 2 comprises a sequence that contains at least 3 of the amino acids $Z_1Z_2$FLI [SEQ ID NO:798], where $Z_1$, is or I and $Z_2$ is Q or R, and wherein Domain 2 does not contain an N- to C-terminal contiguous primary sequence of ILFQY [SEQ ID NO:799], ILFQ [SEQ ID NO:800] or ILIQ [SEQ ID NO:801], (iii) Domain 3 comprises a sequence chosen from:

| | |
|---|---|
| RXRBRXRB | [SEQ ID NO: 772] |
| XRBRXRB | [SEQ ID NO: 773] |
| RXRRBRB | [SEQ ID NO: 774] |
| BRXRB | [SEQ ID NO: 775] |
| XRRBRB | [SEQ ID NO: 776] |
| RRBRB | [SEQ ID NO: 777] |
| XRBRB | [SEQ ID NO: 778] |
| RBRXRB | [SEQ ID NO: 779] |
| RXRBRB, or | [SEQ ID NO: 780] |
| BRBRB | [SEQ ID NO: 781] | wherein X=aminohexanoic acid, B=betaAlanine.

* * * * *